US008906876B2

(12) United States Patent
Raemaekers et al.

(10) Patent No.: US 8,906,876 B2
(45) Date of Patent: Dec. 9, 2014

(54) METHODS FOR CONTROLLING PESTS USING RNAI

(75) Inventors: Romaan Raemaekers, De Pinte (BE); Laurent Kubler, Beynost (FR); Geert Karel Maria Plaetinck, Bottelare (BE); Els Vanbleu, Berlare (BE); Thierry Andre Olivier Eddy Bogaert, Kortrijk (BE)

(73) Assignee: Devgen NV, Zwijnaarde (BE)

( * ) Notice: Subject to any disclaimer, the term of this patent is extended or adjusted under 35 U.S.C. 154(b) by 0 days.

(21) Appl. No.: 13/592,513

(22) Filed: Aug. 23, 2012

(65) Prior Publication Data

US 2013/0058890 A1    Mar. 7, 2013

Related U.S. Application Data

(63) Continuation-in-part of application No. 12/087,537, filed as application No. PCT/EP2007/000287 on Jan. 12, 2007.

(60) Provisional application No. 60/758,191, filed on Jan. 12, 2006, provisional application No. 60/771,160, filed on Feb. 7, 2006, provisional application No. 60/837,910, filed on Aug. 16, 2006, provisional application No. 60/875,362, filed on Dec. 18, 2006.

(30) Foreign Application Priority Data

Jan. 12, 2006  (EP) .................................... 06447008

(51) Int. Cl.
*A61K 48/00* (2006.01)
*C07H 21/02* (2006.01)
*C07H 21/04* (2006.01)

(52) U.S. Cl.
USPC ........ 514/44; 536/23.1; 536/24.3; 536/24.31; 536/24.33; 536/24.5

(58) Field of Classification Search
None
See application file for complete search history.

(56) References Cited

U.S. PATENT DOCUMENTS

| 6,703,491 B1 | 3/2004 | Homburger et al. |
| 2003/0150017 A1 | 8/2003 | Mesa et al. |
| 2005/0287570 A1 | 12/2005 | Mounts |
| 2006/0021087 A1 | 1/2006 | Baum et al. |
| 2006/0272049 A1 | 11/2006 | Waterhouse et al. |
| 2008/0113351 A1 | 5/2008 | Naito et al. |
| 2009/0285784 A1 | 11/2009 | Raemaekers et al. |
| 2009/0298787 A1 | 12/2009 | Raemaekers et al. |

FOREIGN PATENT DOCUMENTS

| WO | WO 99/32619 A1 | 7/1999 |
| WO | WO 99/53050 A1 | 10/1999 |
| WO | WO 00/01846 A2 | 1/2000 |
| WO | WO 00/55376 A1 | 9/2000 |
| WO | WO 01/09301 A2 | 2/2001 |
| WO | WO 01/37654 A2 | 5/2001 |
| WO | WO 01/71042 A2 | 9/2001 |
| WO | WO 01/88121 A1 | 11/2001 |
| WO | WO 02/46432 A2 | 6/2002 |
| WO | WO 03/004644 A1 | 1/2003 |
| WO | WO 04/001013 A2 | 12/2003 |
| WO | WO 2005/019408 A2 | 3/2005 |
| WO | WO 2005/047300 A2 | 5/2005 |
| WO | WO 2005/049841 A1 | 6/2005 |
| WO | WO 2005/110068 A2 | 11/2005 |
| WO | WO 2005/116204 A1 | 12/2005 |
| WO | WO 2007/083193 A2 | 7/2007 |

OTHER PUBLICATIONS

Accession CO334556 (EST Jun. 29, 2004).*
GenBank Submission; EMBL; Accession No. AM048926. Longhorn; Jul. 16, 2005.
GenBank Submission; NCBI; Accession No. ABL02283. Newton et al.; Nov. 19, 2010.
GenBank Submission; NCBI; Accession No. AM106685. Dillon et al.; Dec. 23, 2005.
GenBank Submission; NCBI; Accession No. AR508074. Homburger et al.; Sep. 22, 2004.
GenBank Submission; NCBI; Accession No. BT001619. Stapleton et al.; Nov. 15, 2002.
GenBank Submission; NCBI; Accession No. CB602554. Srinivasan et al.; Apr. 4, 2003.
GenBank Submission; NCBI; Accession No. CK811880. Siviero et al.; Dec. 1, 2004.
GenBank Submission; NCBI; Accession No. DN200332. Hunter et al.; Feb. 25, 2005.
GenBank Submission; NCBI; Accession No. FW658194. Naito et al.; Apr. 18, 2011. Sequence first appeared in PCT application WO 2005/116204, published Dec. 8, 2005.
GenBank Submission; UniProt, Accession No. Q4GXU7. Aug. 30, 2005.
Baumann et al., Sequence analysis of DNA fragments from the genome of the primary endosymbiont of the whitefly Bemisia tabaci. Curr Microbiol. Jan. 2004;48(1):77-81.

(Continued)

*Primary Examiner* — Amy Bowman

(57) ABSTRACT

The present invention concerns methods for controlling insect infestation via RNAi-mediated gene silencing, whereby the intact insect cell(s) are contacted with a double-stranded RNA from outside the insect cell(s) and whereby the double-stranded RNA is taken up by the intact insect cell(s). In one particular embodiment, the methods of the invention are used to alleviate plants from insect pests. Alternatively, the methods are used for treating and/or preventing insect infestation on a substrate or a subject in need of such treatment and/or prevention. Suitable insect target genes and fragments thereof, dsRNA constructs, recombinant constructs and compositions are disclosed.

30 Claims, 25 Drawing Sheets

(56) References Cited

OTHER PUBLICATIONS

Clough et al., Floral dip: a simplified method for Agrobacterium-mediated transformation of *Arabidopsis thaliana*. Plant J. Dec. 1998;16(6):735-43.

Elbashir et al., Functional anatomy of siRNAs for mediating efficient RNAi in *Drosophila melanogaster* embryo lysate. EMBO J. Dec. 3, 2001;20(23):6877-88.

Febvay et al., Influence of the amino acid balance on the improvement of an artificial diet for a biotype of *Acyrthosiphon pisum* (Homoptera: Aphididae). Can. J. Zool. 1988;66(11):2449-2453.

Fire, RNA-triggered gene silencing. Trends Genet. Sep. 1999;15(9):358-63.

Hamada et al., Effects on RNA interference in gene expression (RNAi) in cultured mammalian cells of mismatches and the introduction of chemical modifications at the 3'-ends of siRNAs. Antisense Nucleic Acid Drug Dev. Oct. 2002;12(5):301-9.

Koyama, Artificial rearing and nutritional physiology of the planthoppers and leafhoppers (Hemiptera: Delphacidae and Deltocephalidae) on a holidic diet. Japan Agricultural Research Quarterly. 1988;22(1):20-27.

Parrish et al., Functional anatomy of a dsRNA trigger: differential requirement for the two trigger strands in RNA interference. Mol Cell. Nov. 2000;6(5):1077-87.

Qiu et al., A computational study of off-target effects of RNA interference. Nucleic Acids Res. Mar. 30, 2005;33(6):1834-47.

Rice et al., EMBOSS: the European Molecular Biology Open Software Suite. Trends Genet. Jun. 2000;16(6):276-7.

Roberts et al., Loss of SEC-23 in *Caenorhabditis elegans* causes defects in oogenesis, morphogenesis, and extracellular matrix secretion. Mol Biol Cell. Nov. 2003;14(11):4414-26. Epub Aug. 7, 2003.

Robertson et al., Diversity of odourant binding proteins revealed by an expressed sequence tag project on male *Manduca sexta* moth antennae. Insect Mol Biol. Nov. 1999;8(4):501-18.

Severson et al., Linkage map organization of expressed sequence tags and sequence tagged sites in the mosquito, *Aedes aegypti*. Insect Mol Biol. Aug. 2002;11(4):371-8.

Sharp, RNA interference—2001. Genes Dev. Mar. 1, 2001;15(5):485-90.

Soares et al., Capillary feeding of specific dsRNA induces silencing of the isac gene in nymphal *Ixodes scapularis* ticks. Insect Mol Biol. Aug. 2005;14(4):443-52.

Thomas et al., Size constraints for targeting post-transcriptional gene silencing and for RNA-directed methylation in *Nicotiana benthamiana* using a potato virus X vector. Plant J. Feb. 2001;25(4):417-25.

Timmons et al., Ingestion of bacterially expressed dsRNAs can produce specific and potent genetic interference in *Caenorhabditis elegans*. Gene. Jan. 24, 2001;263(1-2):103-12.

Whyard et al., Ingested double-stranded RNAs can act as species-specific insecticides. Insect Biochem Mol Biol. 2009; 39:824-832.

Zhu et al., Ingested RNA interference for managing the populations of the Colorado potato beetle, *Leptinotarsa decemlineata*. Pest Manag Sci. Feb. 2011;67(2):175-82.

\* cited by examiner

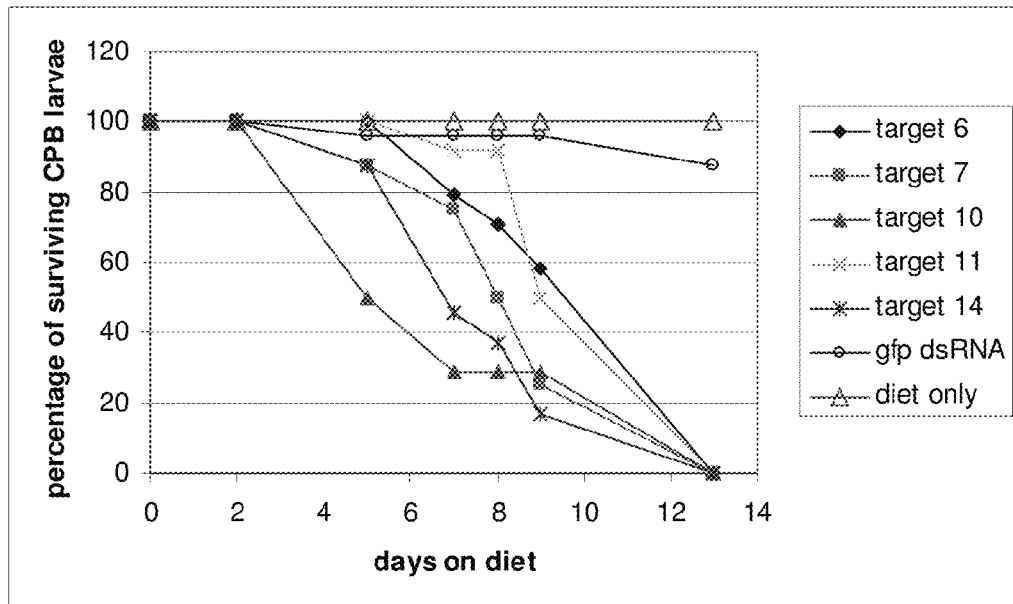
FIGURE 1-LD
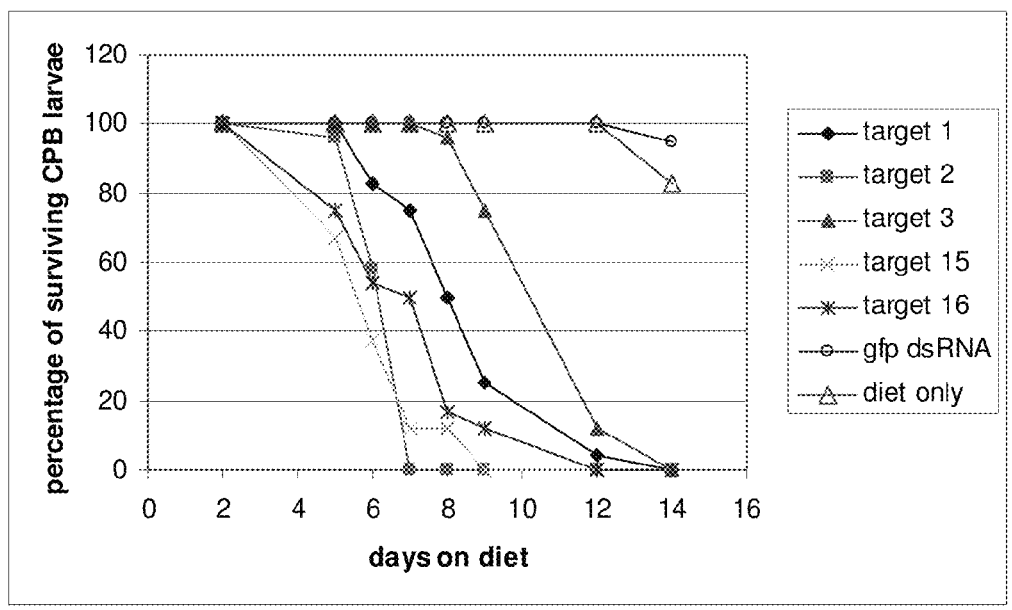
FIGURE 2-LD

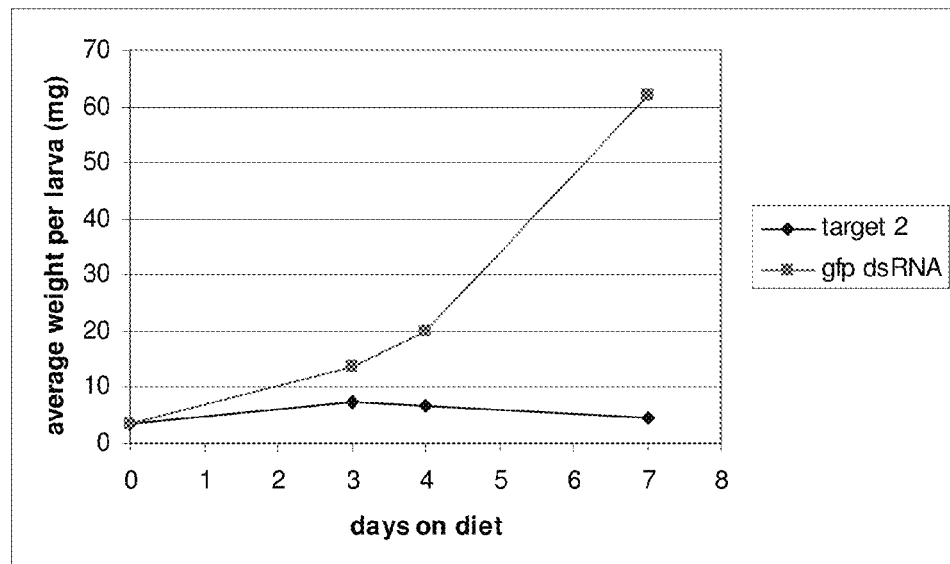
FIGURE 3-LD
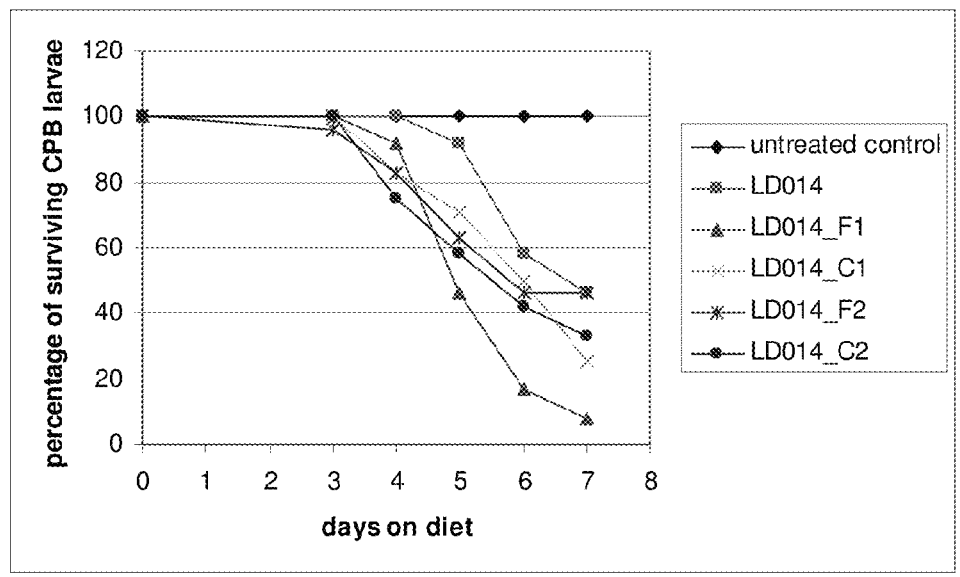
FIGURE 4-LD

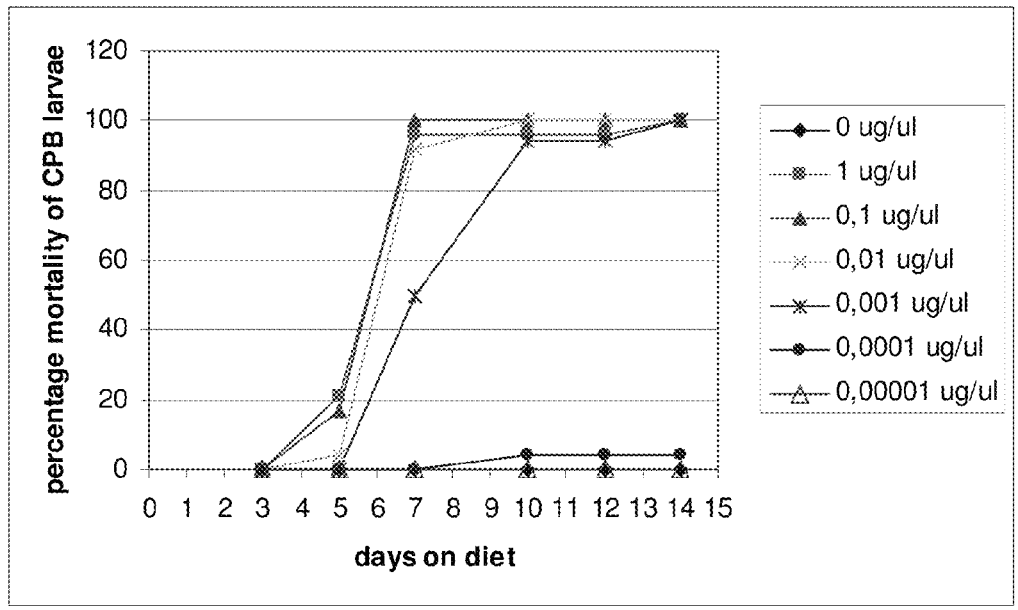
FIGURE 5-LD (a)
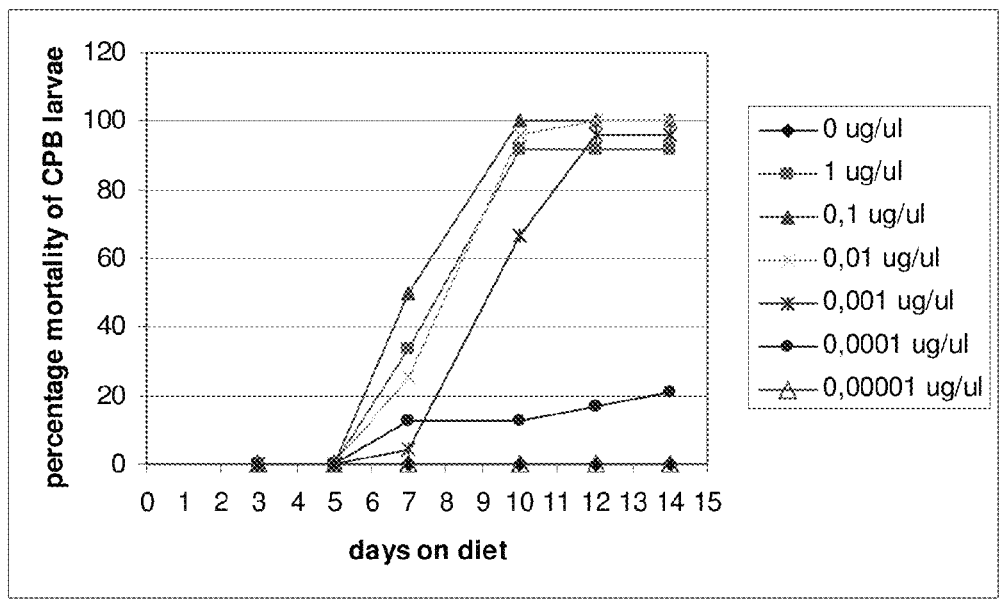
FIGURE 5-LD (b)

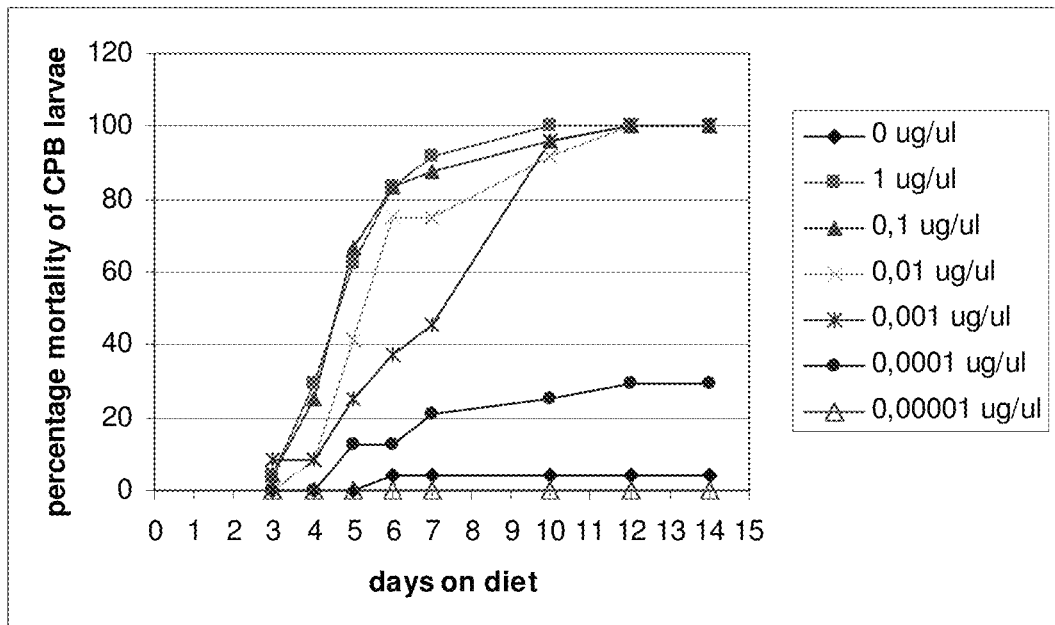
FIGURE 5-LD (c)
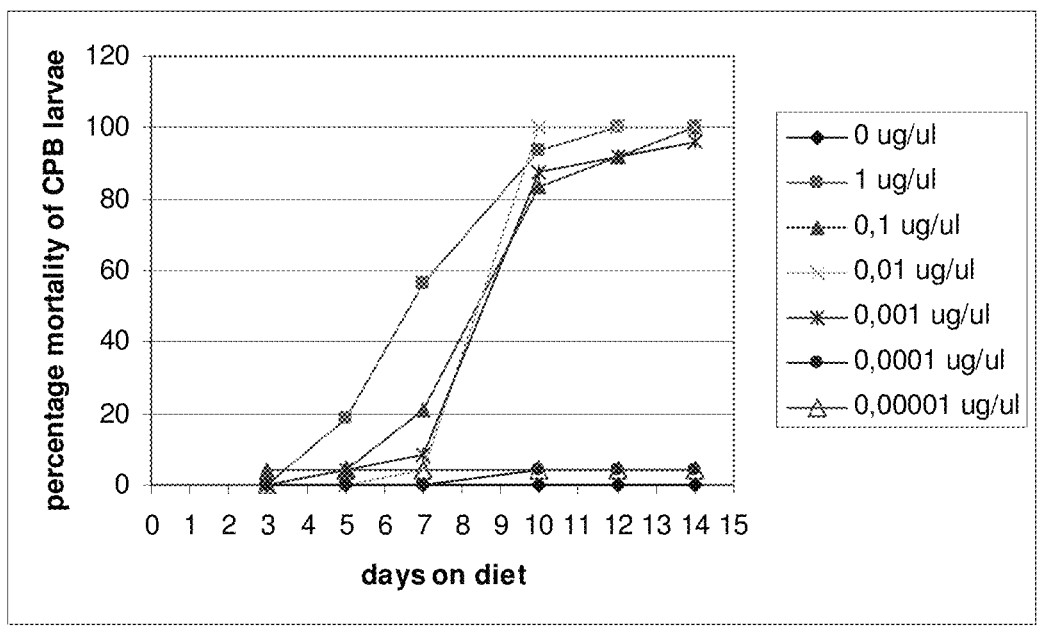
FIGURE 5-LD (d)

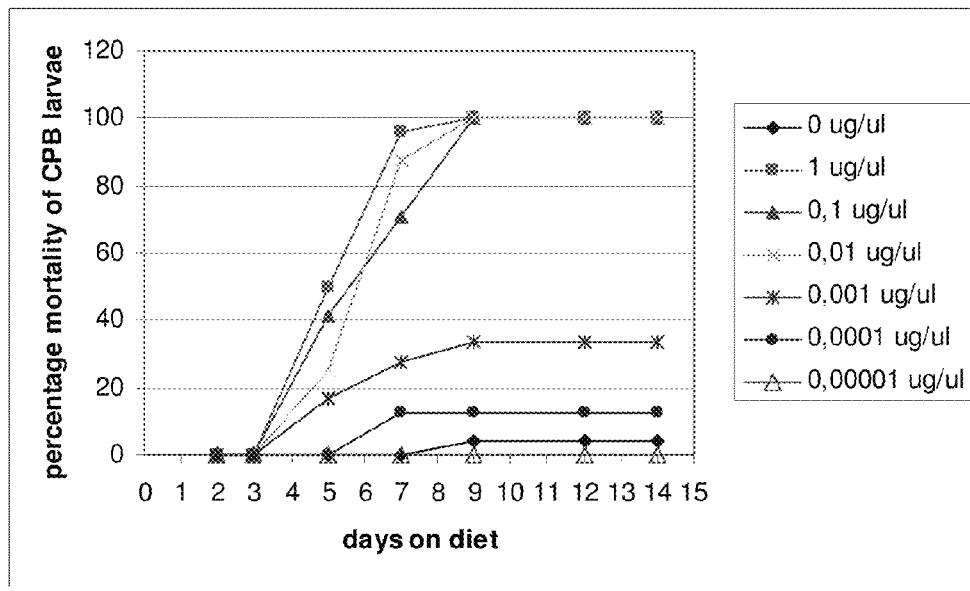
FIGURE 5-LD (e)
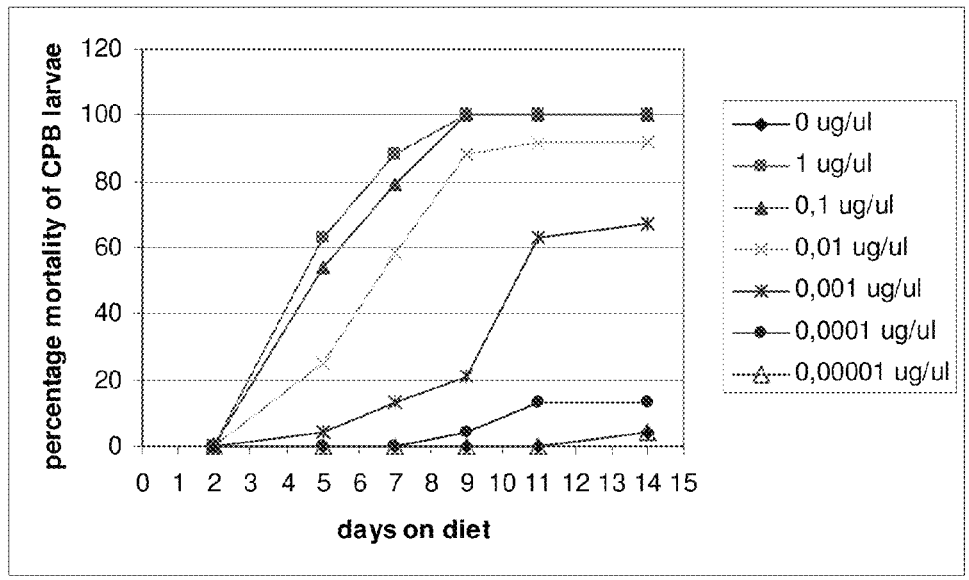
FIGURE 5-LD (f)

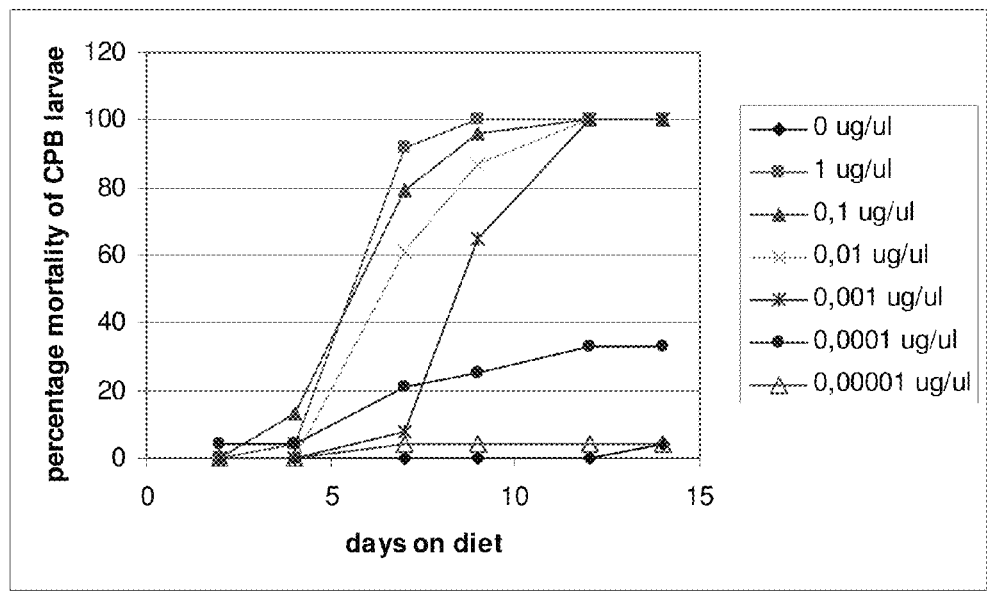
FIGURE 5-LD (g)
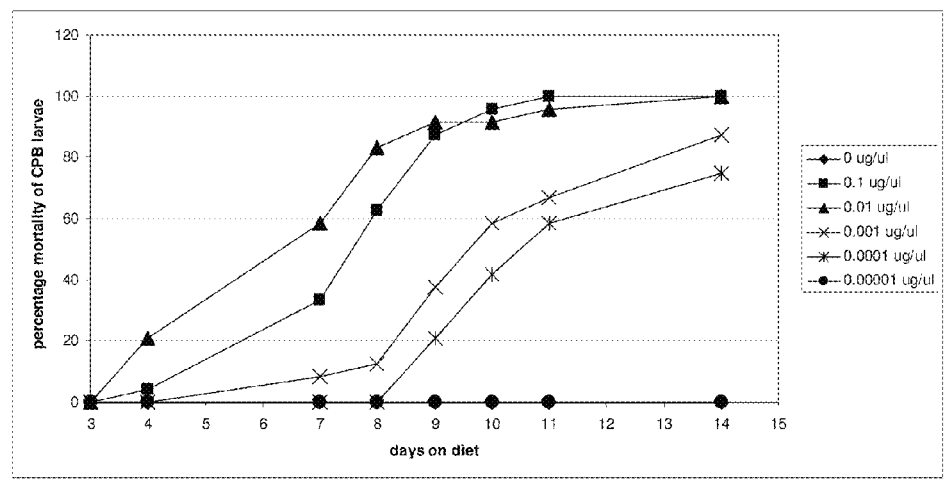
FIGURE 5-LD (h)

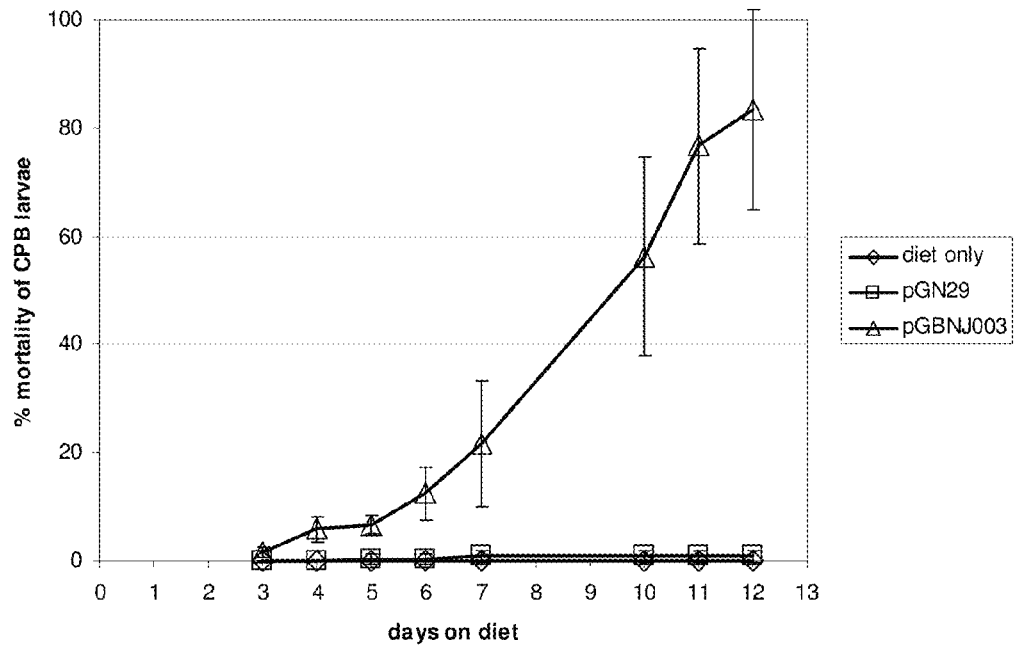
FIGURE 6-LD (a)
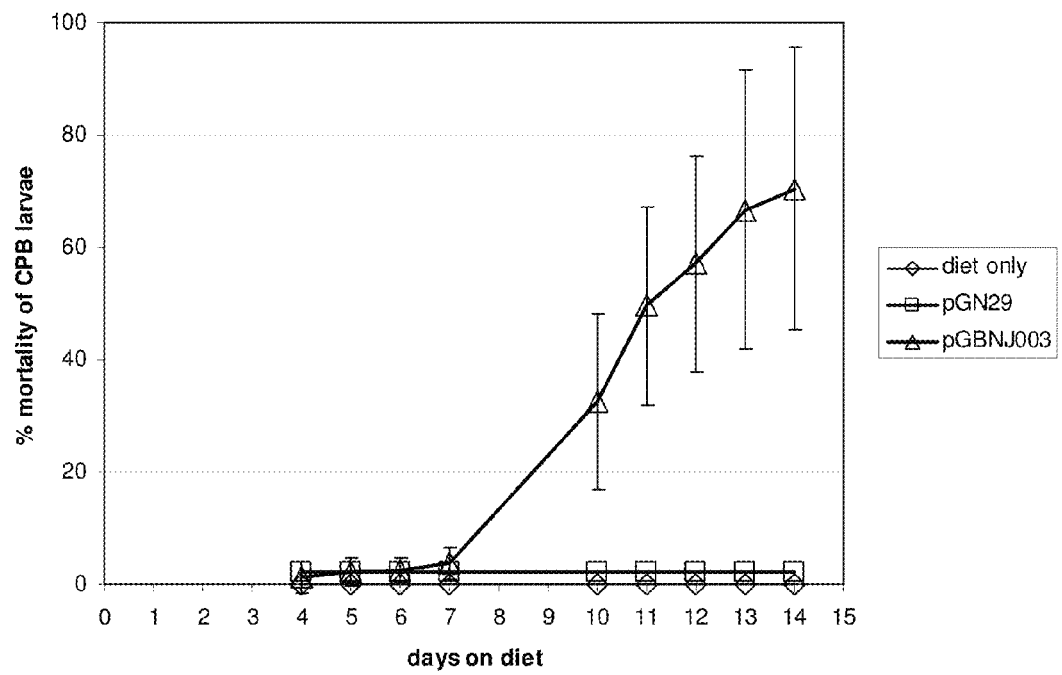
FIGURE 6-LD (b)

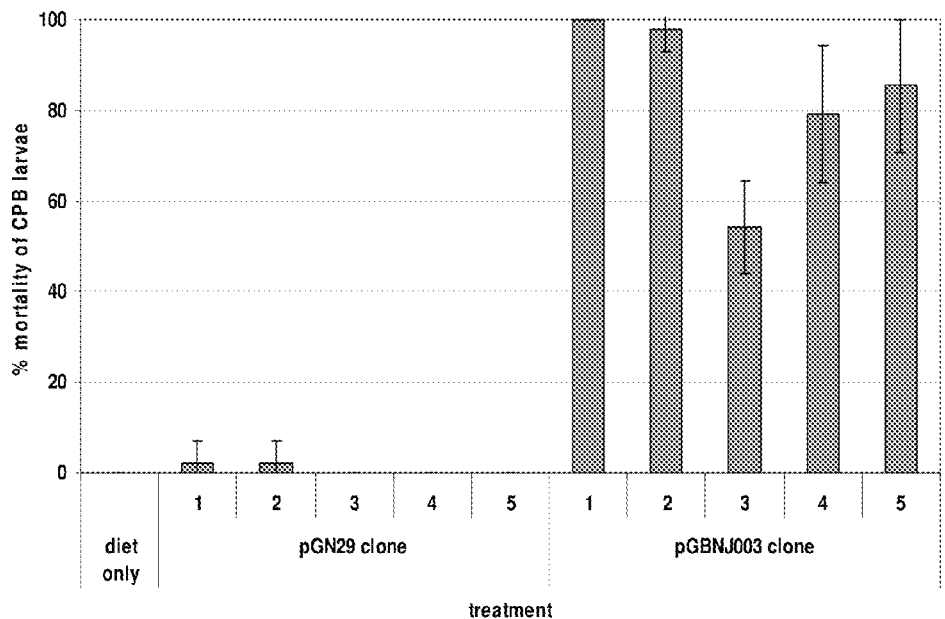
FIGURE 7-LD (a)
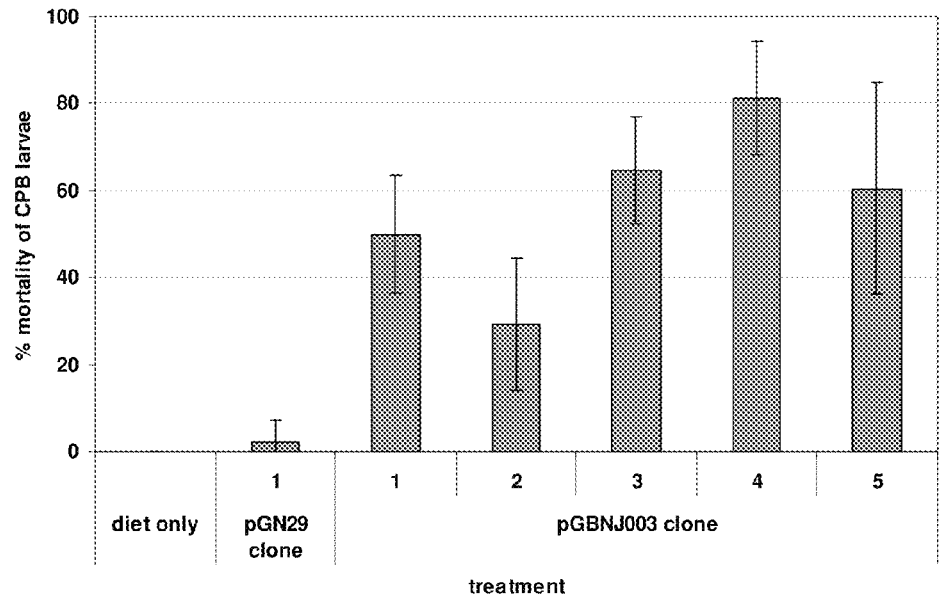
FIGURE 7-LD (b)

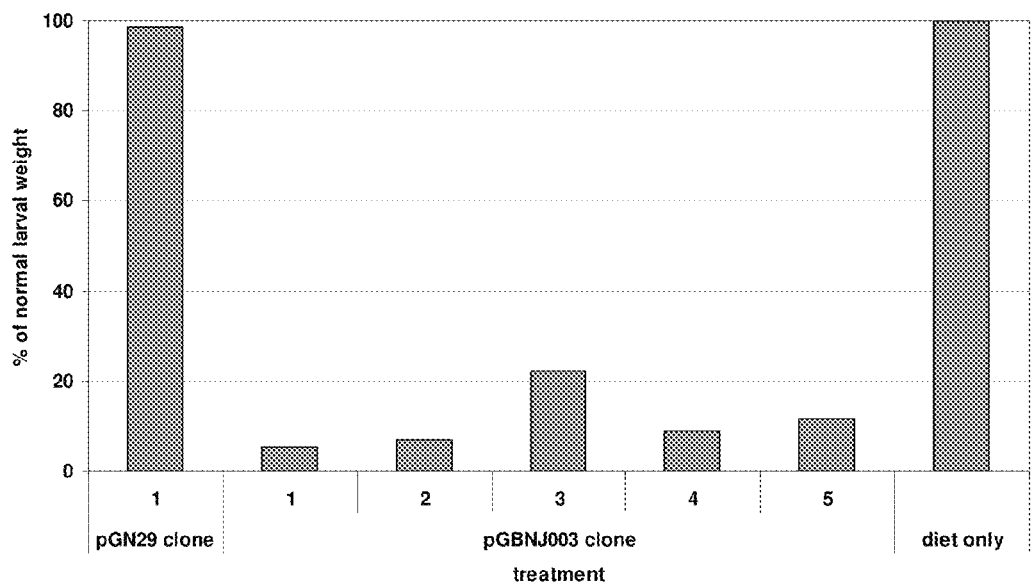
FIGURE 8-LD (a)
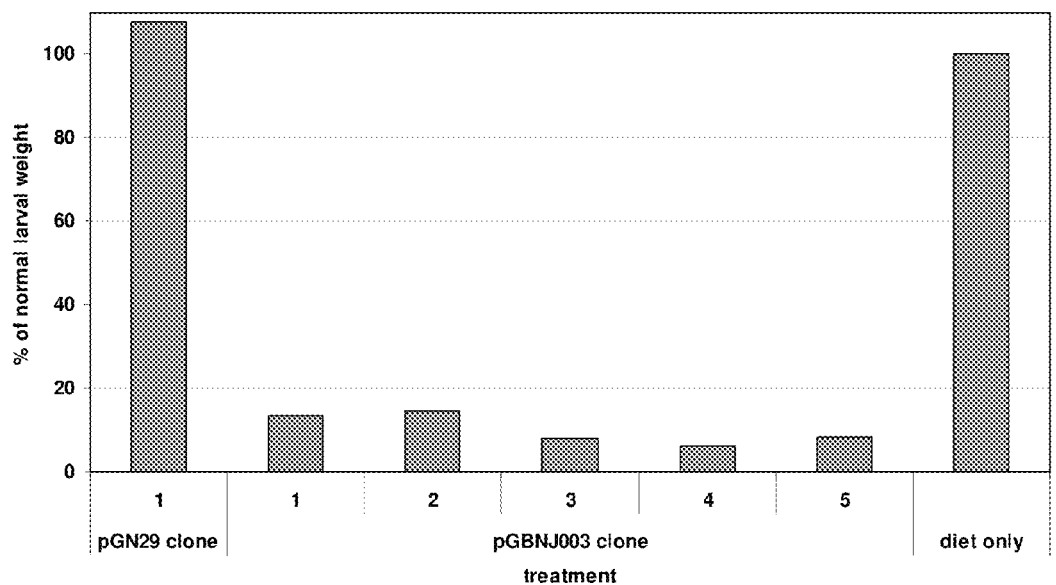
FIGURE 8-LD (b)

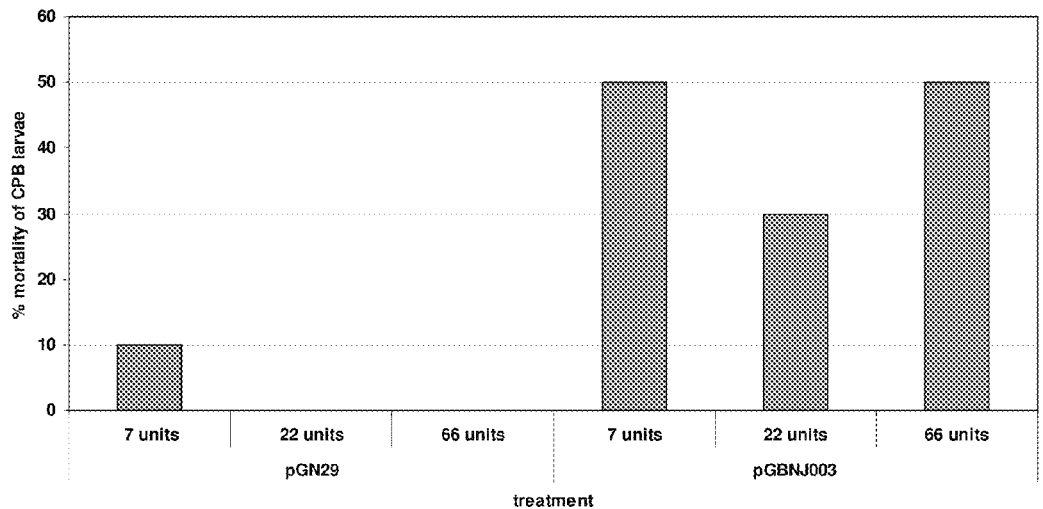
FIGURE 9-LD
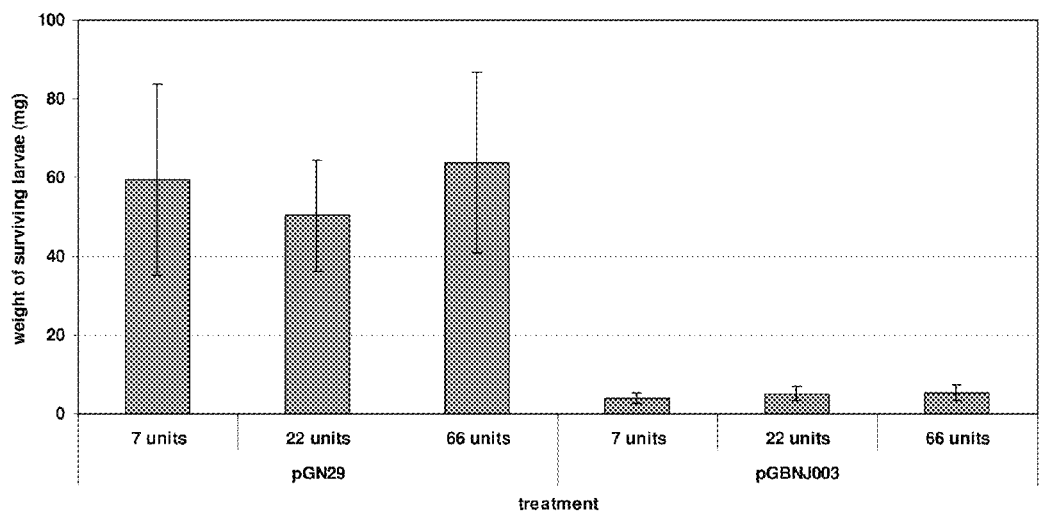
FIGURE 10-LD

FIGURE 11-LD

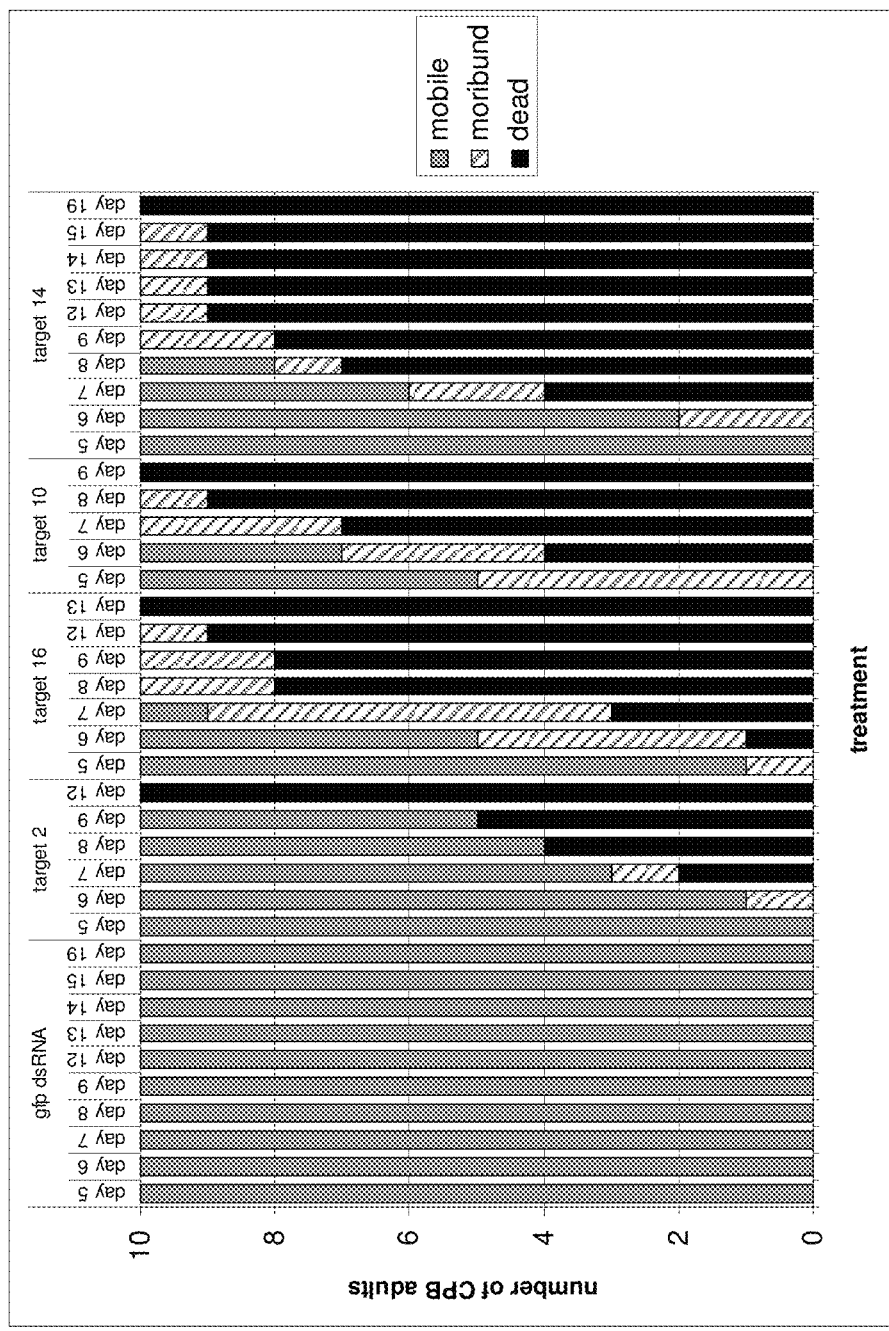
FIGURE 12-LD

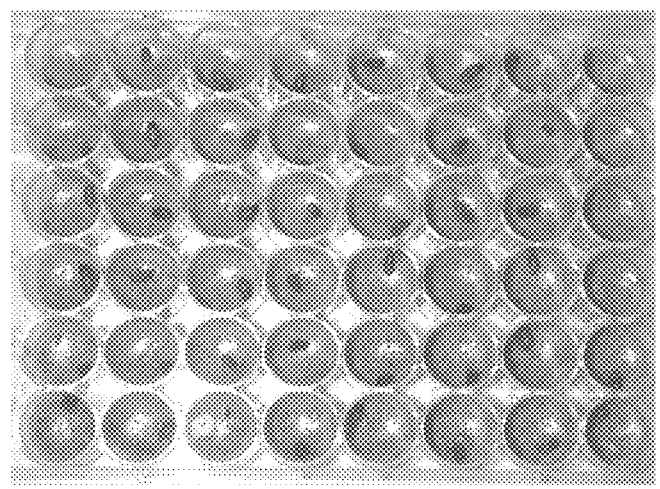
FIGURE 13-LD (a)
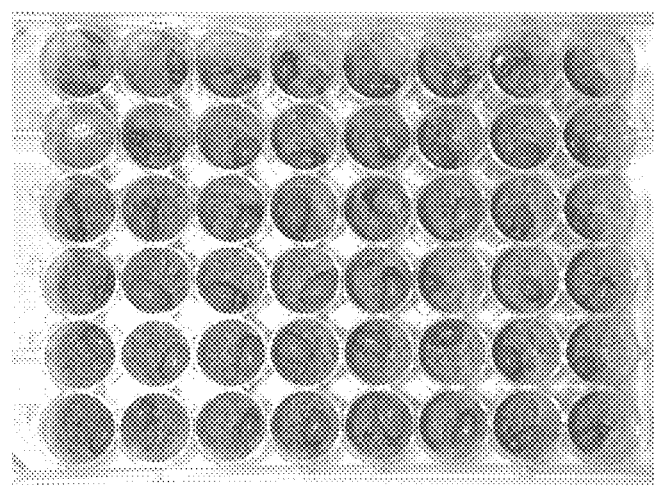
FIGURE 13-LD (b)
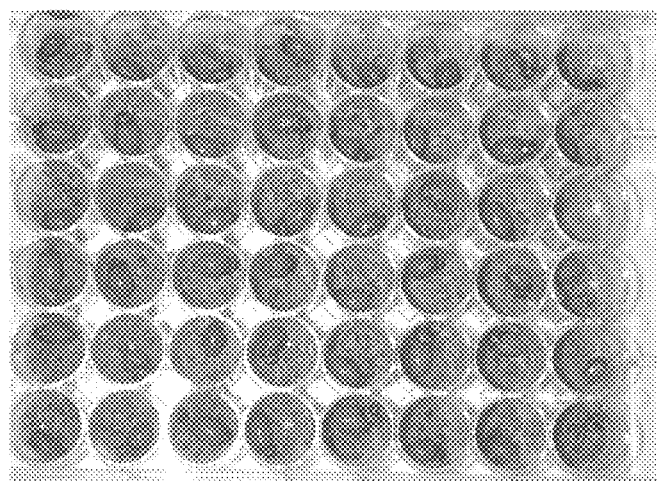
FIGURE 13-LD (c)

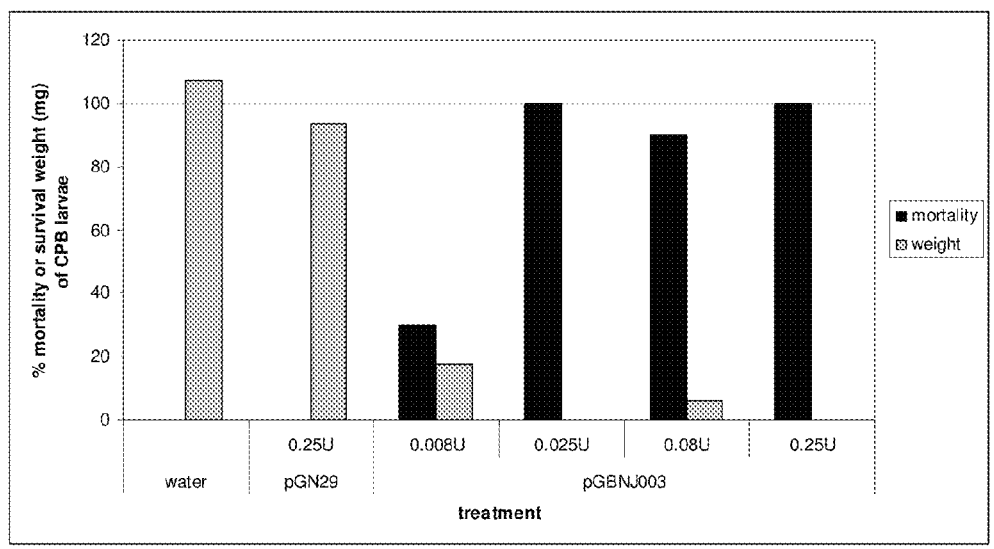
FIGURE 14-LD

FIGURE 15-LD (b)
FIGURE 15-LD (d)
FIGURE 15-LD (a)
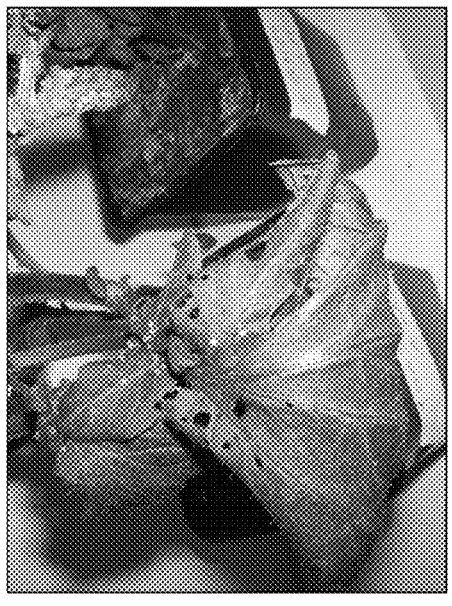
FIGURE 15-LD (c)

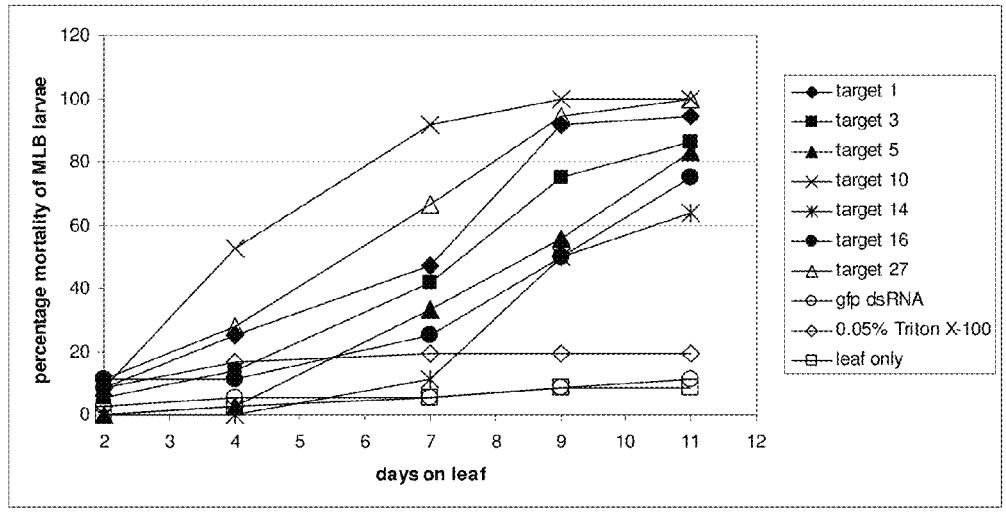
FIGURE 1-PC (a)
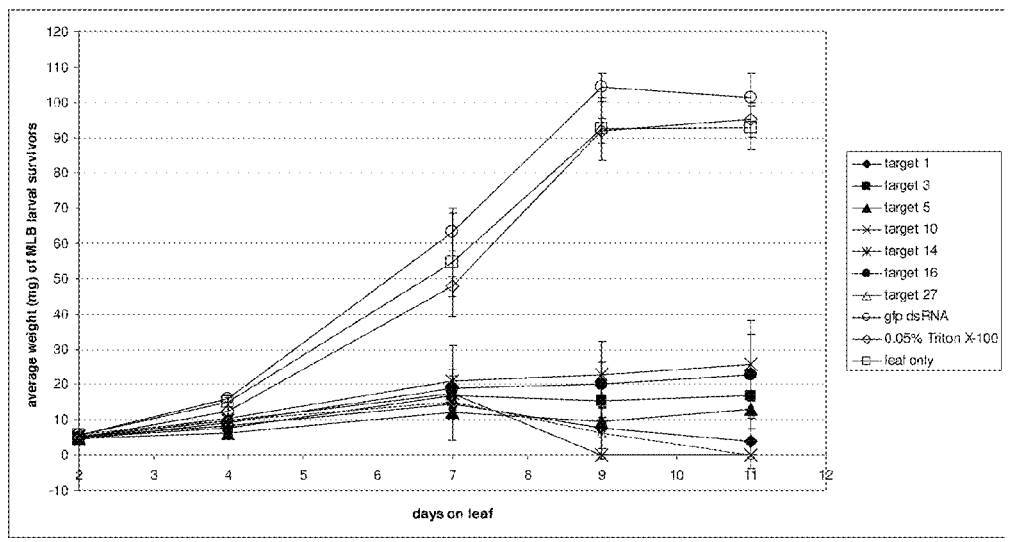
FIGURE 1-PC (b)

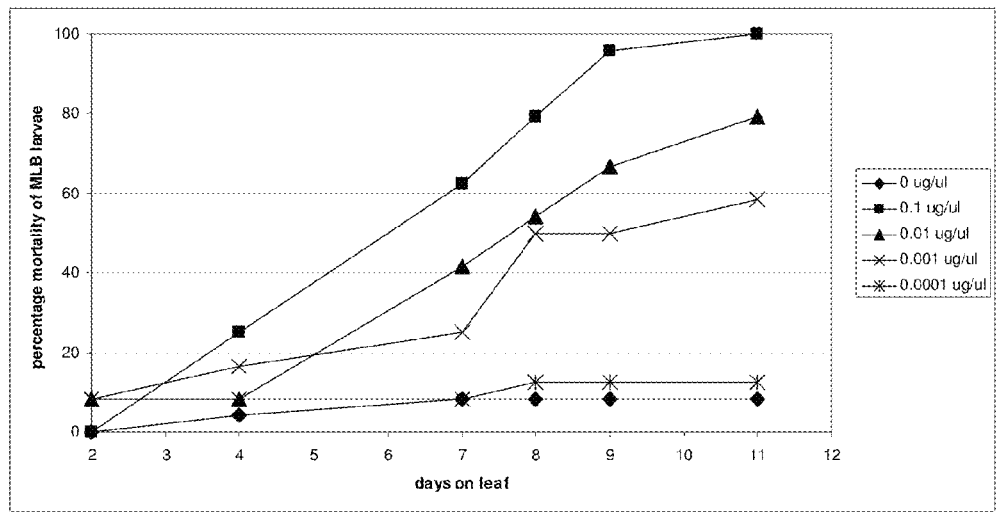
FIGURE 2-PC (a)
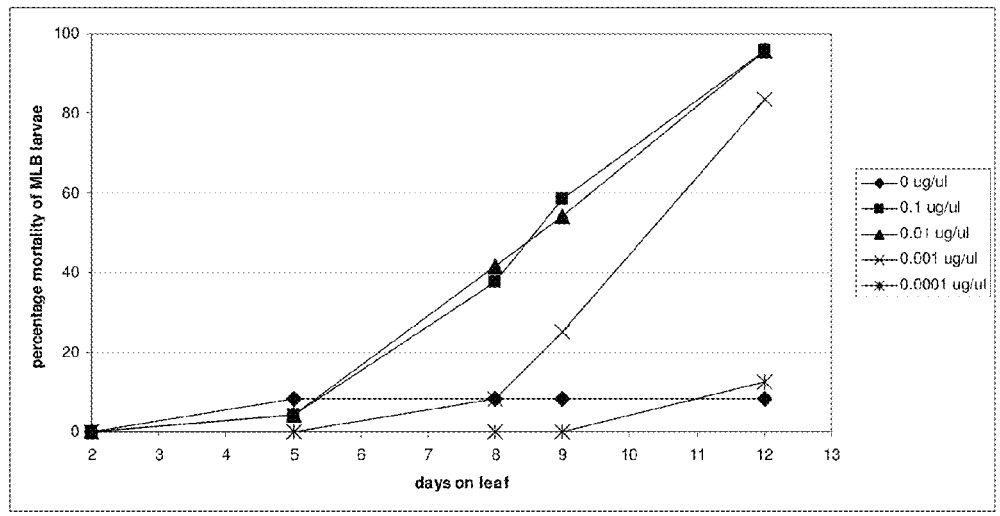
FIGURE 2-PC (b)

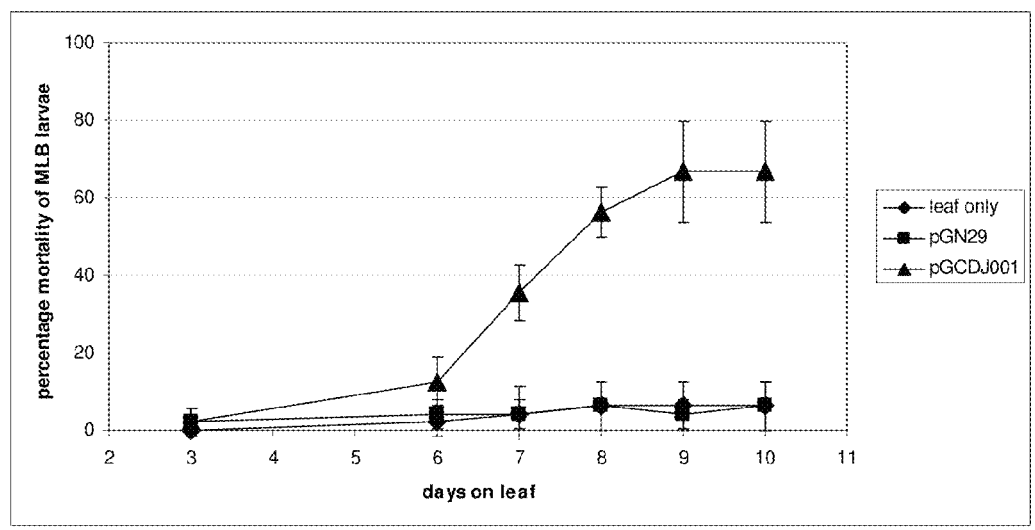
FIGURE 3-PC

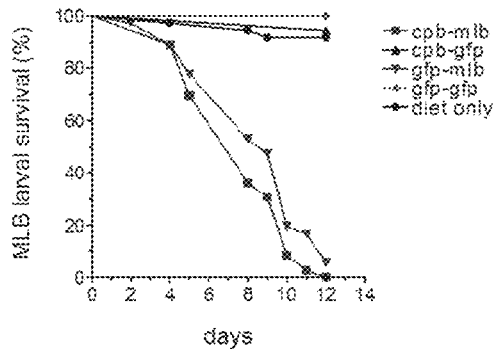
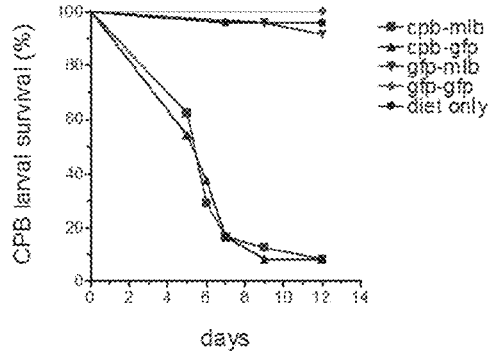
FIGURE 4-PC

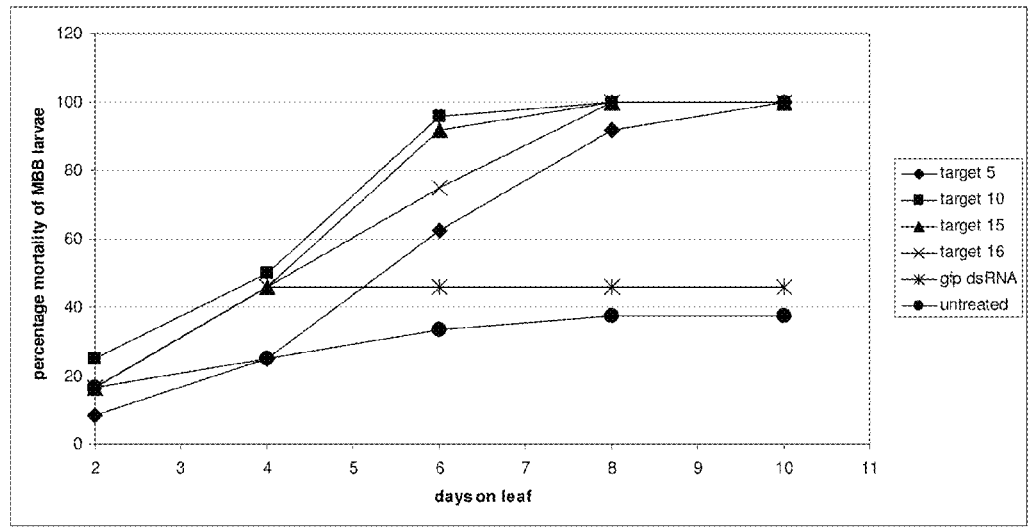
FIGURE 1-EV
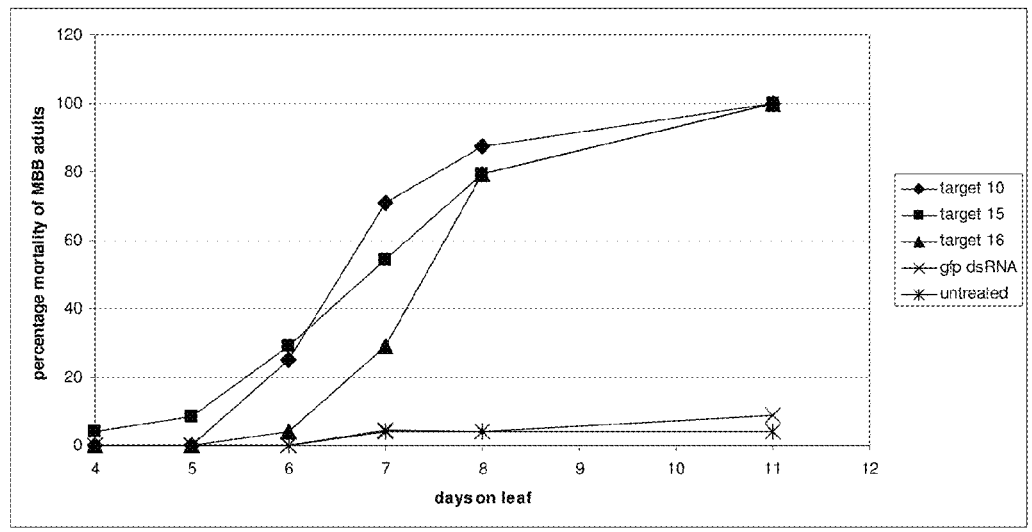
FIGURE 2-EV (a)

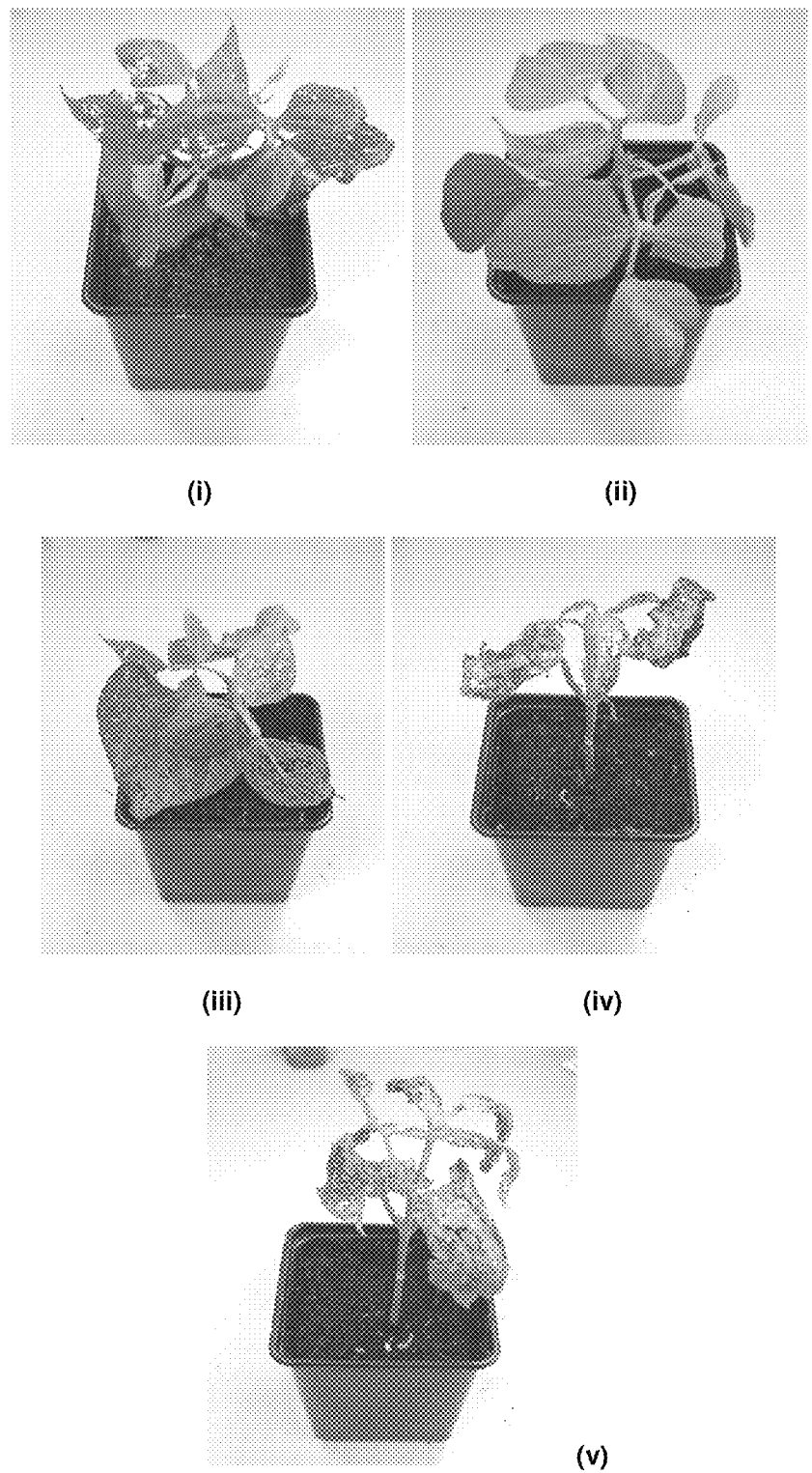
FIGURE 2-EV (b)

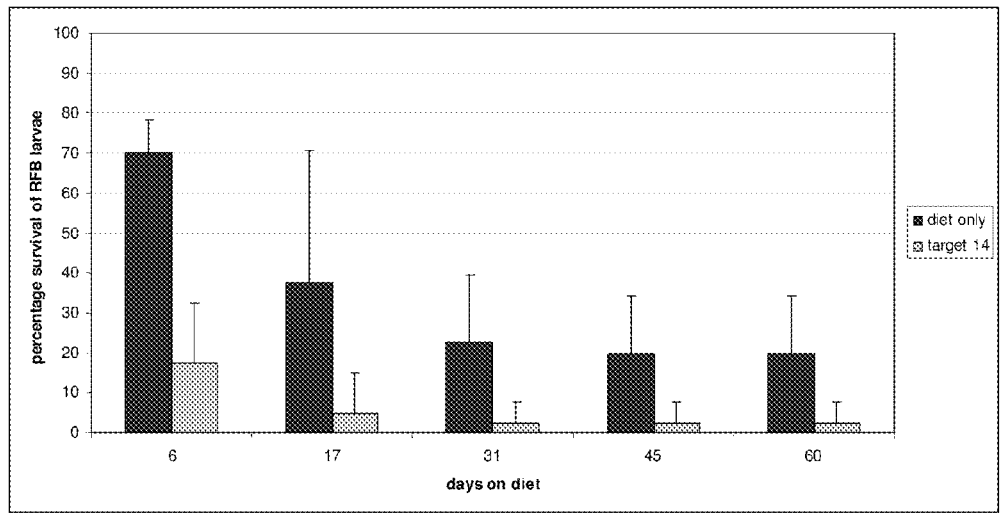
FIGURE 1-TC
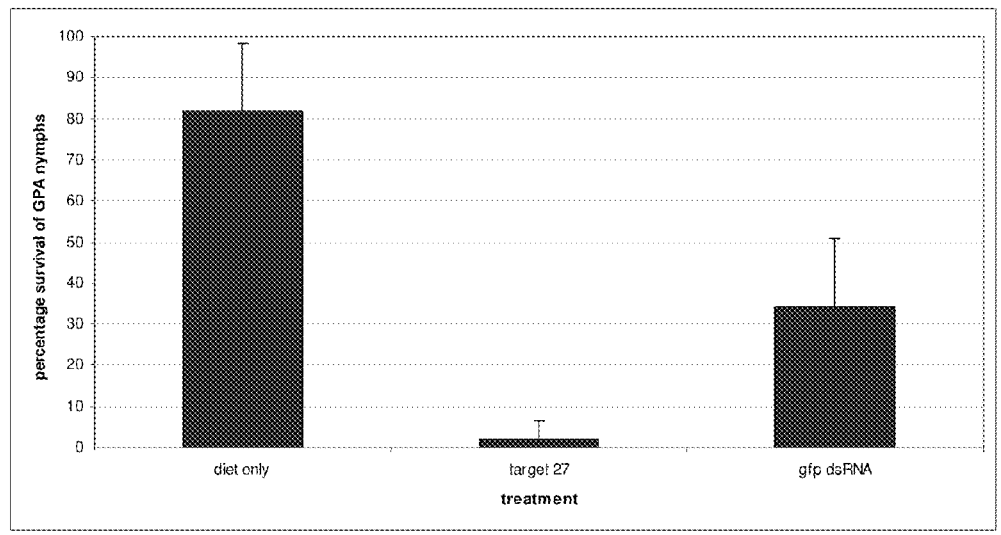
FIGURE 1-MP

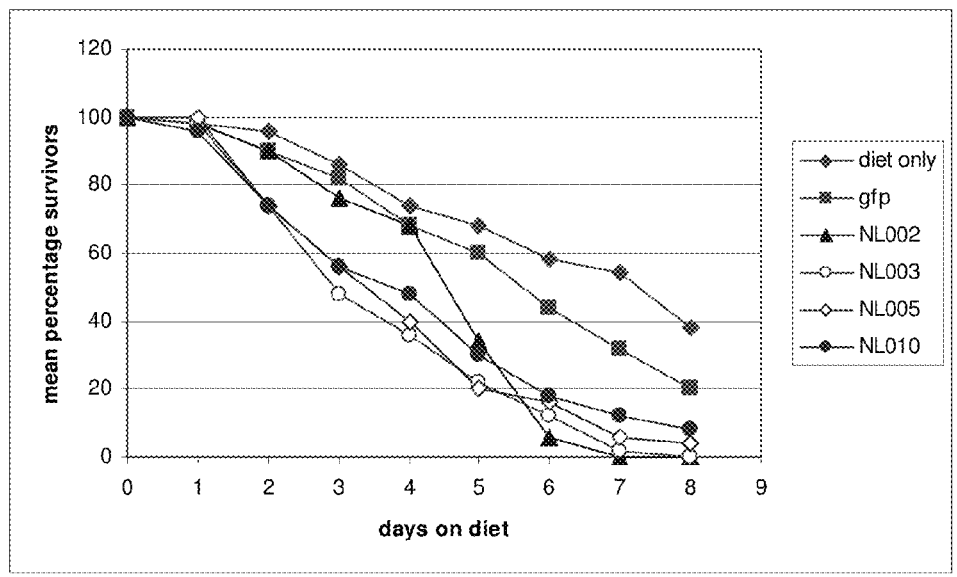
FIGURE 1-NL (a)
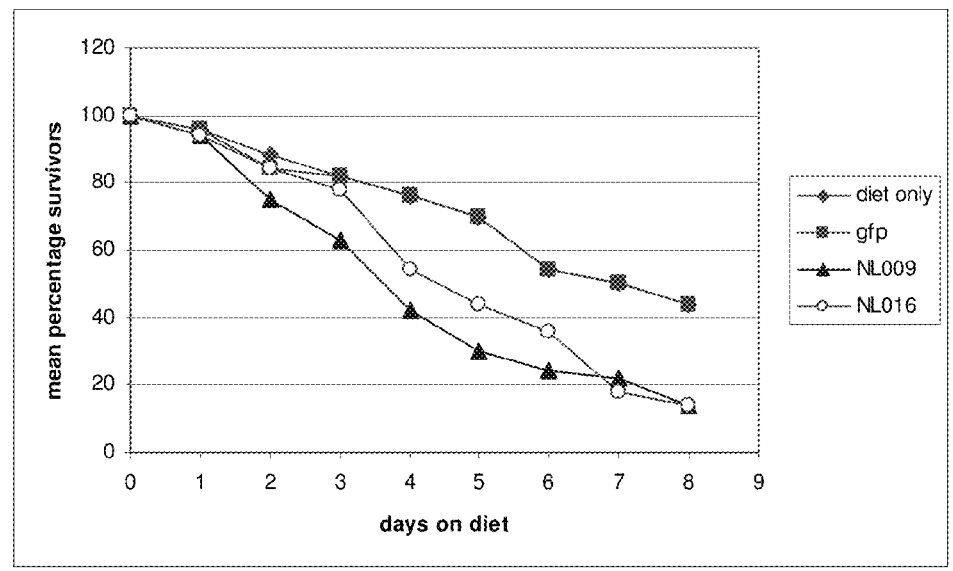
FIGURE 1-NL (b)

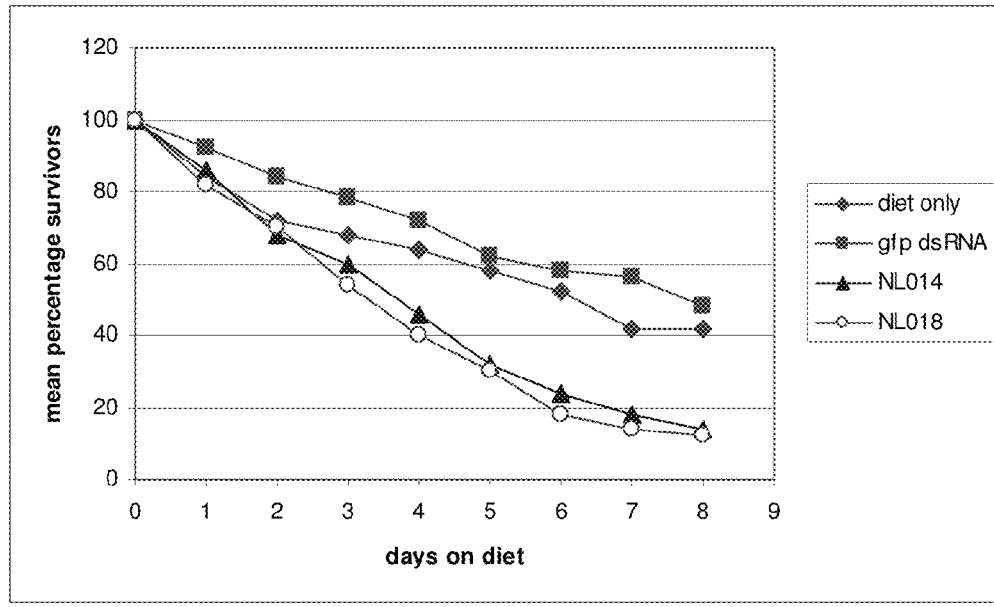
FIGURE 1-NL (c)
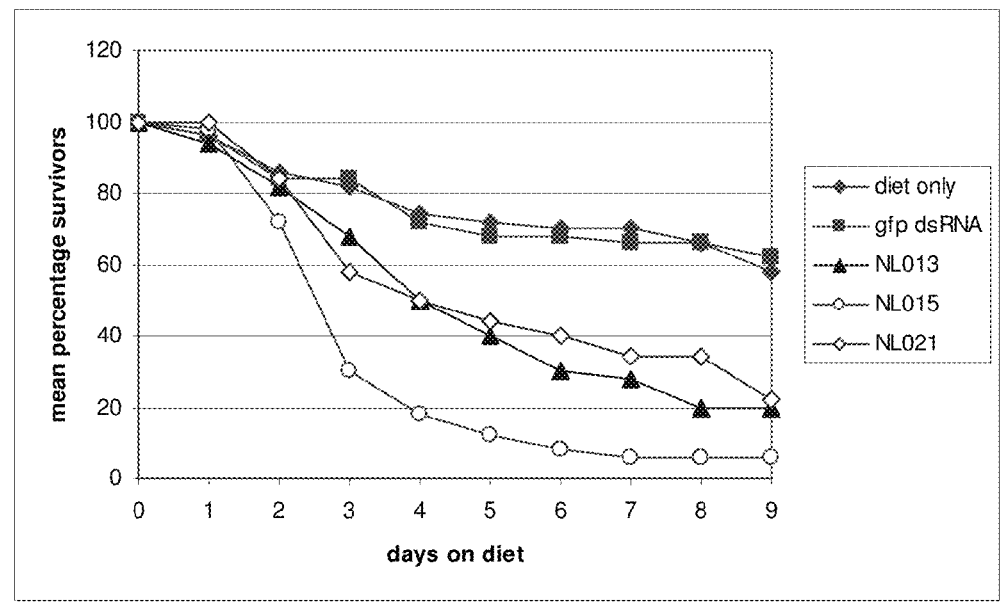
FIGURE 1-NL (d)

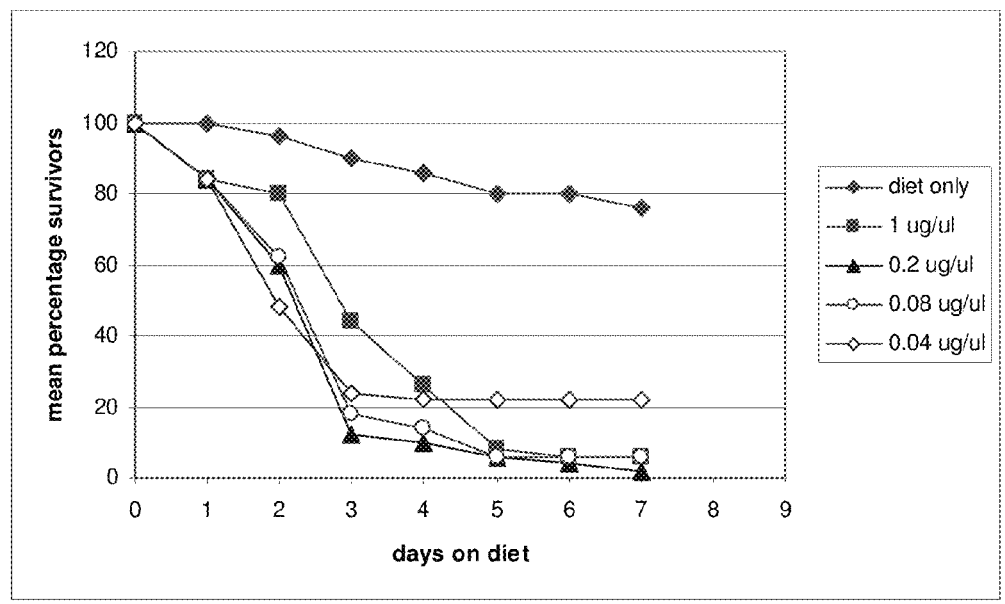
FIGURE 2-NL

METHODS FOR CONTROLLING PESTS USING RNAI

RELATED APPLICATIONS

This application is a continuation-in-part of U.S. patent application Ser. No. 12/087,537 filed Jul. 9, 2008, which is a national stage filing under 35 U.S.C. §371 of international application PCT/EP2007/000287, filed Jan. 12, 2007, which was published under PCT Article 21(2) in English, and claims priority under 35 U.S.C. §119(e) to U.S. provisional application 60/758,191, filed Jan. 12, 2006, to U.S. provisional application 60/771,160, filed Feb. 7, 2006, to U.S. provisional application 60/837,910, filed Aug. 16, 2006, and to U.S. provisional application 60/875,362, filed Dec. 18, 2006, the disclosures of which are incorporated herein by reference.

FIELD OF THE INVENTION

The present invention relates to the field of double-stranded RNA (dsRNA)-mediated gene silencing in insect species. More particularly, the present invention relates to genetic constructs designed for the expression of dsRNA corresponding to novel target genes. These constructs are particularly useful in RNAi-mediated insect pest control. The invention further relates to methods for controlling insects, methods for preventing insect infestation and methods for down-regulating gene expression in insects using RNAi.

BACKGROUND TO THE INVENTION

Insect and other pests can cause injury and even death by their bites or stings. Additionally, many pests transmit bacteria and other pathogens that cause diseases. For example, mosquitoes transmit pathogens that cause malaria, yellow fever, encephalitis, and other diseases. The bubonic plague, or black death, is caused by bacteria that infect rats and other rodents. Compositions for controlling microscopic pest infestations have been provided in the form of antibiotic, antiviral, and antifungal compositions. Methods for controlling infestations by pests, such as nematodes and insects, have typically been in the form of chemical compositions that are applied to surfaces on which pests reside, or administered to infested animals in the form of pellets, powders, tablets, pastes, or capsules.

Control of insect pests on agronomically important crops is an important field, for instance insect pests which damage plants belonging to the Solanaceae family, especially potato (*Solanum tuberosum*), but also tomato (*Solanum lycopersicum*), eggplant (*Solanum melongena*), capsicums (*Solanum capsicum*), and nightshade (for example, *Solanum aculeastrum, S. bulbocastanum, S. cardiophyllum, S. douglasii, S. dulcamara, S. lanceolatum, S. robustum*, and *S. triquetrum*), particularly the control of coleopteran pests.

Substantial progress has been made in the last few decades towards developing more efficient methods and compositions for controlling insect infestations in plants. Chemical pesticides have been very effective in eradicating pest infestations.

Biological control using extract from neem seed has been shown to work against coleopteran pests of vegetables. Commercially available neem-based insecticides have azadirachtin as the primary active ingredient. These insecticides are applicable to a broad spectrum of insects. They act as insect growth regulator; azadirachtin prevents insects from molting by inhibiting production of an insect hormone, ecdysone.

Biological control using protein Cry3A from *Bacillus thuringiensis* varieties tenebrionis and san diego, and derived insecticidal proteins are alternatives to chemical control. The Bt toxin protein is effective in controlling Colorado potato beetle larvae either as formulations sprayed onto the foliage or expressed in the leaves of potatoes.

An alternative biological agent is dsRNA. Over the last few years, down-regulation of genes (also referred to as "gene silencing") in multicellular organisms by means of RNA interference or "RNAi" has become a well-established technique.

RNA interference or "RNAi" is a process of sequence-specific down-regulation of gene expression (also referred to as "gene silencing" or "RNA-mediated gene silencing") initiated by double-stranded RNA (dsRNA) that is complementary in sequence to a region of the target gene to be down-regulated (Fire, A. Trends Genet. Vol. 15, 358-363, 1999; Sharp, P. A. Genes Dev. Vol. 15, 485-490, 2001).

Over the last few years, down-regulation of target genes in multicellular organisms by means of RNA interference (RNAi) has become a well established technique. Reference may be made to International Applications WO 99/32619 (Carnegie Institution) and WO 00/01846 (by Applicant).

DsRNA gene silencing finds application in many different areas, such as for example dsRNA mediated gene silencing in clinical applications (WO2004/001013) and in plants. In plants, dsRNA constructs useful for gene silencing have also been designed to be cleaved and to be processed into short interfering RNAs (siRNAs).

Although the technique of RNAi has been generally known in the art in plants, *C. elegans* and mammalian cells for some years, to date little is known about the use of RNAi to down-regulate gene expression in insects. Since the filing and publication of the WO 00/01846 and WO 99/32619 applications, only few other applications have been published that relate to the use of RNAi to protect plants against insects. These include the International Applications WO 01/37654 (DNA Plant Technologies), WO 2005/019408 (Bar Ilan University), WO 2005/049841 (CSIRO, Bayer Cropscience), WO 05/047300 (University of Utah Research foundation), and the US application 2003/00150017 (Mesa et al.). The present invention provides target genes and constructs useful in the RNAi-mediated insect pest control. Accordingly, the present invention provides methods and compositions for controlling pest infestation by repressing, delaying, or otherwise reducing gene expression within a particular pest.

DESCRIPTION OF THE INVENTION

The present invention describes a novel non-compound, non-protein based approach for the control of insect crop pests. The active ingredient is a nucleic acid, a double-stranded RNA (dsRNA), which can be used as an insecticidal formulation, for example, as a foliar spray. The sequence of the dsRNA corresponds to part or whole of an essential insect gene and causes downregulation of the insect target via RNA interference (RNAi). As a result of the downregulation of mRNA, the dsRNA prevents expression of the target insect protein and hence causes death, growth arrest or sterility of the insect.

The methods of the invention can find practical application in any area of technology where it is desirable to inhibit viability, growth, development or reproduction of the insect, or to decrease pathogenicity or infectivity of the insect. The methods of the invention further find practical application where it is desirable to specifically down-regulate expression of one or more target genes in an insect. Particularly useful practical applications include, but are not limited to, (1) protecting plants against insect pest infestation; (2) pharmaceutical or veterinary use in humans and animals (for example to control, treat or prevent insect infections in humans and animals); (3) protecting materials against damage caused by insects; (4) protecting perishable materials (such as foodstuffs, seed, etc.) against damage caused by insects; and generally any application wherein insects need to be controlled and/or wherein damage caused by insects needs to be prevented.

In accordance with one embodiment the invention relates to a method for controlling insect growth on a cell or an organism, or for preventing insect infestation of a cell or an organism susceptible to insect infection, comprising contacting insects with a double-stranded RNA, wherein the double-stranded RNA comprises annealed complementary strands, one of which has a nucleotide sequence which is complementary to at least part of the nucleotide sequence of an insect target gene, whereby the double-stranded RNA is taken up by the insect and thereby controls growth or prevents infestation.

The present invention therefore provides isolated novel nucleotide sequences of insect target genes, said isolated nucleotide sequences comprising at least one nucleic acid sequence selected from the group comprising:

(i) sequences represented by any of SEQ ID NOs 1, 3, 5, 7, 9, 11, 13, 15, 17, 19, 21, 23, 49 to 158, 159, 160-163, 168, 173, 178, 183, 188, 193, 198, 203, 208, 215, 220, 225, 230, 240 to 247, 249, 251, 253, 255, 257, 259, 275 to 472, 473, 478, 483, 488, 493, 498, 503, 508 to 513, 515, 517, 519, 521, 533 to 575, 576, 581, 586, 591, 596, 601, 603, 605, 607, 609, 621 to 767, 768, 773, 778, 783, 788, 793, 795, 797, 799, 801, 813 to 862, 863, 868, 873, 878, 883, 888, 890, 892, 894, 896, 908 to 1040, 1041, 1046, 1051, 1056, 1061, 1066 to 1071, 1073, 1075, 1077, 1079, 1081, 1083, 1085, 1087, 1089, 1091, 1093, 1095, 1097, 1099, 1101, 1103, 1105, 1107, 1109, 1111, 1113, 1161 to 1571, 1572, 1577, 1582, 1587, 1592, 1597, 1602, 1607, 1612, 1617, 1622, 1627, 1632, 1637, 1642, 1647, 1652, 1657, 1662, 1667, 1672, 1677, 1682, 1684, 1686, 1688, 1690, 1692, 1694, 1696, 1698, 1700, 1702, 1704, 1730 to 2039, 2040, 2045, 2050, 2055, 2060, 2065, 2070, 2075, 2080, 2085, 2090, 2095, 2100, 2102, 2104, 2106, 2108, 2120 to 2338, 2339, 2344, 2349, 2354, 2359, 2364, 2366, 2368, 2370, 2372, 2384 to 2460, 2461, 2466, 2471, 2476, 2481, 2486, 2487, 2488, 2493 or 2495, or the complement thereof, (ii) sequences which are at least 70%, preferably at least 75%, 80%, 85%, 90%, more preferably at least 95%, 96%, 97%, 98% or 99% identical to a sequence represented by any of SEQ ID NOs 1, 3, 5, 7, 9, 11, 13, 15, 17, 19, 21, 23, 49 to 158, 159, 160-163, 168, 173, 178, 183, 188, 193, 198, 203, 208, 215, 220, 225, 230, 240 to 247, 249, 251, 253, 255, 257, 259, 275 to 472, 473, 478, 483, 488, 493, 498, 503, 508 to 513, 515, 517, 519, 521, 533 to 575, 576, 581, 586, 591, 596, 601, 603, 605, 607, 609, 621 to 767, 768, 773, 778, 783, 788, 793, 795, 797, 799, 801, 813 to 862, 863, 868, 873, 878, 883, 888, 890, 892, 894, 896, 908 to 1040, 1041, 1046, 1051, 1056, 1061, 1066 to 1071, 1073, 1075, 1077, 1079, 1081, 1083, 1085, 1087, 1089, 1091, 1093, 1095, 1097, 1099, 1101, 1103, 1105, 1107, 1109, 1111, 1113, 1161 to 1571, 1572, 1577, 1582, 1587, 1592, 1597, 1602, 1607, 1612, 1617, 1622, 1627, 1632, 1637, 1642, 1647, 1652, 1657, 1662, 1667, 1672, 1677, 1682, 1684, 1686, 1688, 1690, 1692, 1694, 1696, 1698, 1700, 1702, 1704, 1730 to 2039, 2040, 2045, 2050, 2055, 2060, 2065, 2070, 2075, 2080, 2085, 2090, 2095, 2100, 2102, 2104, 2106, 2108, 2120 to 2338, 2339, 2344, 2349, 2354, 2359, 2364, 2366, 2368, 2370, 2372, 2384 to 2460, 2461, 2466, 2471, 2476, 2481, 2486, 2487, 2488, 2493 or 2495, or the complement thereof, and (iii) sequences comprising at least 17 contiguous nucleotides of any of the sequences represented by SEQ ID NOs 1, 3, 5, 7, 9, 11, 13, 15, 17, 19, 21, 23, 49 to 158, 159, 160-163, 168, 173, 178, 183, 188, 193, 198, 203, 208, 215, 220, 225, 230, 240 to 247, 249, 251, 253, 255, 257, 259, 275 to 472, 473, 478, 483, 488, 493, 498, 503, 508 to 513, 515, 517, 519, 521, 533 to 575, 576, 581, 586, 591, 596, 601, 603, 605, 607, 609, 621 to 767, 768, 773, 778, 783, 788, 793, 795, 797, 799, 801, 813 to 862, 863, 868, 873, 878, 883, 888, 890, 892, 894, 896, 908 to 1040, 1041, 1046, 1051, 1056, 1061, 1066 to 1071, 1073, 1075, 1077, 1079, 1081, 1083, 1085, 1087, 1089, 1091, 1093, 1095, 1097, 1099, 1101, 1103, 1105, 1107, 1109, 1111, 1113, 1161 to 1571, 1572, 1577, 1582, 1587, 1592, 1597, 1602, 1607, 1612, 1617, 1622, 1627, 1632, 1637, 1642, 1647, 1652, 1657, 1662, 1667, 1672, 1677, 1682, 1684, 1686, 1688, 1690, 1692, 1694, 1696, 1698, 1700, 1702, 1704, 1730 to 2039, 2040, 2045, 2050, 2055, 2060, 2065, 2070, 2075, 2080, 2085, 2090, 2095, 2100, 2102, 2104, 2106, 2108, 2120 to 2338, 2339, 2344, 2349, 2354, 2359, 2364, 2366, 2368, 2370, 2372, 2384 to 2460, 2461, 2466, 2471, 2476, 2481, 2486, 2487, 2488, 2493 or 2495, or the complement thereof, or wherein said nucleic acid sequence is an orthologue of a gene comprising at least 17 contiguous nucleotides of any of SEQ ID NOs 49 to 158, 275 to 472, 533 to 575, 621 to 767, 813 to 862, 908 to 1040, 1161 to 1571, 1730 to 2039, 2120 to 2338, 2384 to 2460, or a complement thereof, said nucleic acid sequences being useful for preparing the double stranded RNAs of the invention for controlling insect growth.

"Controlling pests" as used in the present invention means killing pests, or preventing pests to develop, or to grow or preventing pests to infect or infest. Controlling pests as used herein also encompasses controlling insect progeny (development of eggs). Controlling pests as used herein also encompasses inhibiting viability, growth, development or reproduction of the insect, or to decrease pathogenicity or infectivity of the insect. The compounds and/or compositions described herein, may be used to keep an organism healthy and may be used curatively, preventively or systematically to control pests or to avoid insect growth or development or infection or infestation.

Particular pests envisaged by the present invention are insect pests. Controlling insects as used herein thus also encompasses controlling insect progeny (such as development of eggs, for example for insect pests). Controlling insects as used herein also encompasses inhibiting viability, growth, development or reproduction of the insect, or decreasing pathogenicity or infectivity of the insect. In the present invention, controlling insects may inhibit a biological activity in an insect, resulting in one or more of the following attributes: reduction in feeding by the insect, reduction in viability of the insect, death of the insect, inhibition of differentiation and development of the insect, absence of or reduced capacity for sexual reproduction by the insect, muscle formation, juvenile hormone formation, juvenile hormone regulation, ion regulation and transport, maintenance of cell membrane potential, amino acid biosynthesis, amino acid degradation, sperm formation, pheromone synthesis, pheromone sensing, antennae formation, wing formation, leg formation, development and differentiation, egg formation, larval maturation, digestive enzyme formation, haemolymph synthesis, haemolymph maintenance, neurotransmission, cell division, energy metabolism, respiration, apoptosis, and any component of a eukaryotic cells' cytoskeletal structure, such as, for example, actins and tubulins. The compounds and/or compositions described herein, may be used to keep an organism healthy and may be used curatively, preventively or systematically to control an insect or to avoid insect growth or development or infection or infestation. Thus, the invention may allow previously susceptible organisms to develop resistance against infestation by the insect organism.

The expression "complementary to at least part of" as used herein means that the nucleotide sequence is fully complementary to the nucleotide sequence of the target over more than two nucleotides, for instance over at least 15, 16, 17, 18, 19, 20, 21, 22, 23, 24 or more contiguous nucleotides.

According to a further embodiment, the invention relates to a method method for down-regulating expression of a target gene in an insect, comprising contacting said insect with a double-stranded RNA, wherein the double-stranded RNA comprises annealed complementary strands, one of which has a nucleotide sequence which is complementary to at least part of the nucleotide sequence of the insect target gene to be down-regulated, whereby the double-stranded RNA is taken up into the insect and thereby down-regulates expression of the insect target gene.

Whenever the term "a" is used within the context of "a target gene", this means "at least one" target gene. The same applies for "a" target organism meaning "at least one" target organism, and "a" RNA molecule or host cell meaning "at least one" RNA molecule or host cell. This is also detailed further below.

According to one embodiment, the methods of the invention rely on uptake by the insect of double-stranded RNA present outside of the insect (e.g. by feeding) and does not require expression of double-stranded RNA within cells of the insect. In addition, the present invention also encompasses methods as described above wherein the insect is contacted with a composition comprising the double-stranded RNA.

Said double-stranded RNA may be expressed by a prokaryotic (for instance, but not limited to, a bacterial) or eukaryotic (for instance, but not limited to, a yeast) host cell or host organism.

The insect can be any insect, meaning any organism belonging to the Kingdom Animals, more specific to the Phylum Arthropoda, and to the Class Insecta or the Class Arachnida. The methods of the invention are applicable to all insects that are susceptible to gene silencing by RNA interference and that are capable of internalising double-stranded RNA from their immediate environment. The invention is also applicable to the insect at any stage in its development. Because insects have a non-living exoskeleton, they cannot grow at a uniform rate and rather grow in stages by periodically shedding their exoskeleton. This process is referred to as moulting or ecdysis. The stages between moults are referred to as "instars" and these stages may be targeted according to the invention. Also, insect eggs or live young may also be targeted according to the present invention. All stages in the developmental cycle, which includes metamorphosis in the pterygotes, may be targeted according to the present invention. Thus, individual stages such as larvae, pupae, nymph etc stages of development may all be targeted.

In one embodiment of the invention, the insect may belong to the following orders: Acari, Araneae, Anoplura, Coleoptera, Collembola, Dermaptera, Dictyoptera, Diplura, Diptera, Embioptera, Ephemeroptera, Grylloblatodea, Hemiptera, Homoptera, Hymenoptera, Isoptera, Lepidoptera, Mallophaga, Mecoptera, Neuroptera, Odonata, Orthoptera, Phasmida, Plecoptera, Protura, Psocoptera, Siphonaptera, Siphunculata, Thysanura, Strepsiptera, Thysanoptera, Trichoptera, and Zoraptera.

In preferred, but non-limiting, embodiments and methods of the invention the insect is chosen from the group consisting of:

(1) an insect which is a plant pest, such as but not limited to *Nilaparvata* spp. (e.g. *N. lugens* (brown planthopper)); *Laodelphax* spp. (e.g. *L. striatellus* (small brown planthopper)); *Nephotettix* spp. (e.g. *N. virescens* or *N. cincticeps* (green leafhopper), or *N. nigropictus* (rice leafhopper)); *Sogatella* spp. (e.g. *S. furcifera* (white-backed planthopper)); *Blissus* spp. (e.g. *B. leucopterus leucopterus* (chinch bug)); *Scotinophora* spp. (e.g. *S. vermidulate* (rice blackbug)); *Acrosternum* spp. (e.g. *A. hilare* (green stink bug)); *Parnara* spp. (e.g. *P. guttata* (rice skipper)); *Chilo* spp. (e.g. *C. suppressalis* (rice striped stem borer), *C. auricilius* (gold-fringed stem borer), or *C. polychrysus* (dark-headed stem borer)); *Chilotraea* spp. (e.g. *C. polychrysa* (rice stalk borer)); *Sesamia* spp. (e.g. *S. inferens* (pink rice borer)); *Tryporyza* spp. (e.g. *T. innotata* (white rice borer), or *T. incertulas* (yellow rice borer)); *Cnaphalocrocis* spp. (e.g. *C. medinalis* (rice leafroller)); *Agromyza* spp. (e.g. *A. oryzae* (leafminer), or *A. parvicornis* (corn blot leafminer)); *Diatraea* spp. (e.g. *D. saccharalis* (sugarcane borer), or *D. grandiosella* (southwestern corn borer)); *Narnaga* spp. (e.g. *N. aenescens* (green rice caterpillar)); *Xanthodes* spp. (e.g. *X. transversa* (green caterpillar)); *Spodoptera* spp. (e.g. *S. frugiperda* (fall armyworm), *S. exigua* (beet armyworm), *S. littoralis* (climbing cutworm) or *S. praefica* (western yellowstriped armyworm)); *Mythimna* spp. (e.g. *Mythmna* (*Pseudaletia*) *seperata* (armyworm)); *Helicoverpa* spp. (e.g. *H. zea* (corn earworm)); *Colaspis* spp. (e.g. *C. brunnea* (grape *colaspis*)); *Lissorhoptrus* spp. (e.g. *L. oryzophilus* (rice water weevil)); *Echinocnemus* spp. (e.g. *E. squamos* (rice plant weevil)); *Diclodispa* spp. (e.g. *D. armigera* (rice hispa)); *Oulema* spp. (e.g. *O. oryzae* (leaf beetle); *Sitophilus* spp. (e.g. *S. oryzae* (rice weevil)); *Pachydiplosis* spp. (e.g. *P. oryzae* (rice gall midge)); *Hydrellia* spp. (e.g. *H. griseola* (small rice leafminer), or *H. sasakii* (rice stem maggot)); *Chlorops* spp. (e.g. *C. oryzae* (stem maggot)); *Diabrotica* spp. (e.g. *D. virgifera virgifera* (western corn rootworm), *D. barberi* (northern corn rootworm), *D. undecimpunctata howardi* (southern corn rootworm), *D. virgifera zeae* (Mexican corn rootworm); *D. balteata* (banded cucumber beetle)); *Ostrinia* spp. (e.g. *O. nubilalis* (European corn borer)); *Agrotis* spp. (e.g. *A. ipsilon* (black cutworm)); *Elasmopalpus* spp. (e.g. *E. lignosellus* (lesser cornstalk borer)); *Melanotus* spp. (wireworms); *Cyclocephala* spp. (e.g. *C. borealis* (northern masked chafer), or *C. immaculata* (southern masked chafer)); *Popillia* spp. (e.g. *P. japonica* (Japanese beetle)); *Chaetocnema* spp. (e.g. *C. pulicaria* (corn flea beetle)); *Sphenophorus* spp. (e.g. *S. maidis* (maize billbug)); *Rhopalosiphum* spp. (e.g. *R. maidis* (corn leaf aphid)); *Anuraphis* spp. (e.g. *A. maidiradicis* (corn root aphid)); *Melanoplus* spp. (e.g. *M. femurrubrum* (redlegged grasshopper) *M. differentialis* (differential grasshopper) or *M. sanguinipes* (migratory grasshopper)); *Hylemya* spp. (e.g. *H. platura* (seedcorn maggot)); *Anaphothrips* spp. (e.g. *A. obscrurus* (grass thrips)); *Solenopsis* spp. (e.g. *S. milesta* (thief ant)); or spp. (e.g. *T. urticae* (twospotted spider mite), *T. cinnabarinus* (carmine spider mite); *Helicoverpa* spp. (e.g. *H. zea* (cotton bollworm), or *H. armigera* (American bollworm)); *Pectinophora* spp. (e.g. *P. gossypiella* (pink bollworm)); *Earias* spp. (e.g. *E. vittella* (spotted bollworm)); *Heliothis* spp. (e.g. *H. virescens* (tobacco budworm)); *Anthonomus* spp. (e.g. *A. grandis* (boll weevil)); *Pseudatomoscelis* spp. (e.g. *P. seriatus* (cotton fleahopper)); *Trialeurodes* spp. (e.g. *T. abutiloneus* (banded-winged whitefly) *T. vaporariorum* (greenhouse whitefly)); *Bemisia* spp. (e.g. *B. argentifolii* (silverleaf whitefly)); *Aphis* spp. (e.g. *A. gossypii* (cotton aphid)); *Lygus* spp. (e.g. *L. lineolaris* (tarnished plant bug) or *L. hesperus* (western tarnished plant bug)); *Euschistus* spp. (e.g. *E. conspersus* (consperse stink bug)); *Chlorochroa* spp. (e.g. *C. sayi* (Say stinkbug)); *Nezara* spp. (e.g. *N. viridula* (southern green stinkbug)); *Thrips* spp. (e.g. *T. tabaci* (onion thrips)); *Frankliniella* spp. (e.g. *F. fusca* (tobacco thrips), or *F. occidentalis* (western flower thrips)); *Leptinotarsa* spp. (e.g. *L. decemlineata* (Colorado potato beetle), *L. juncta* (false potato beetle), or *L. texana* (Texan false potato beetle)); *Lema* spp. (e.g. *L. trilineata* (three-lined potato beetle)); *Epitrix* spp. (e.g. *E. cucumeris* (potato flea beetle), *E. hirtipennis* (flea beetle), or *E. tuberis* (tuber flea beetle)); *Epicauta* spp. (e.g. *E. vittata* (striped blister beetle)); *Phaedon* spp. (e.g. *P. cochleariae* (mustard leaf beetle)); *Epilachna* spp. (e.g. *E. varivetis* (mexican bean beetle)); *Acheta* spp. (e.g. *A. domesticus* (house cricket)); *Empoasca* spp. (e.g. *E. fabae* (potato leafhopper)); *Myzus* spp. (e.g. *M. persicae* (green peach aphid)); *Paratrioza* spp. (e.g. *P. cockerelli* (psyllid)); *Conoderus* spp. (e.g. *C. falli* (southern potato wireworm), or *C. vespertinus* (tobacco wireworm)); *Phthorimaea* spp. (e.g. *P. operculella* (potato tuberworm)); *Macrosiphum* spp. (e.g. *M. euphorbiae* (potato aphid)); *Thyanta* spp. (e.g. *T. pallidovirens* (redshouldered stinkbug)); *Phthorimaea* spp. (e.g. *P. operculella* (potato tuberworm)); *Helicoverpa* spp. (e.g. *H. zea* (tomato fruitworm); *Keiferia* spp. (e.g. *K. lycopersicella* (tomato pinworm)); *Limonius* spp. (wireworms); *Manduca* spp. (e.g. *M. sexta* (tobacco hornworm), or *M. quinquemaculata* (tomato hornworm)); *Liriomyza* spp. (e.g. *L. sativae, L. trifolli* or *L. huidobrensis* (leafminer)); *Drosophila* spp. (e.g. *D. melanogaster, D. yakuba, D. pseudoobscura* or *D. simulans*); *Carabus* spp. (e.g. *C. granulatus*); *Chironomus* spp. (e.g. *C. tentanus*); *Ctenocephalides* spp. (e.g. *C. felis* (cat flea)); *Diaprepes* spp. (e.g. *D. abbreviatus* (root weevil)); *Ips* spp. (e.g. *I. pini* (pine engraver)); *Tribolium* spp. (e.g. *T. castaneum* (red floor beetle)); *Glossina* spp. (e.g. *G. morsitans* (tsetse fly)); *Anopheles* spp. (e.g. *A. gambiae* (malaria mosquito)); *Helicoverpa* spp. (e.g. *H. armigera* (African Bollworm)); *Acyrthosiphon* spp. (e.g. *A. pisum* (pea aphid)); *Apis* spp. (e.g. *A. melifera* (honey bee)); *Homalodisca* spp. (e.g. *H. coagulate* (glassy-winged sharpshooter)); *Aedes* spp. (e.g. *Ae. aegypti* (yellow fever mosquito)); *Bombyx* spp. (e.g. *B. mori* (silkworm)); *Locusta* spp. (e.g. *L. migratoria* (migratory locust)); *Boophilus* spp. (e.g. *B. microplus* (cattle tick)); *Acanthoscurria* spp. (e.g. *A. gomesiana* (red-haired chololate bird eater)); *Diploptera* spp. (e.g. *D. punctata* (pacific beetle cockroach)); *Heliconius* spp. (e.g. *H. erato* (red passion flower butterfly) or *H. melpomene* (postman butterfly)); *Curculio* spp. (e.g. *C. glandium* (acorn weevil)); *Plutella* spp. (e.g. *P. xylostella* (diamondback moth)); *Amblyomma* spp. (e.g. *A. variegatum* (cattle tick)); *Anteraea* spp. (e.g. *A. yamamai* (silkmoth)); and *Armigeres* spp. (e.g. *A. subalbatus*);

(2) an insect capable of infesting or injuring humans and/or animals such as, but not limited to those with piercing-sucking mouthparts, as found in Hemiptera and some Hymenoptera and Diptera such as mosquitos, bees, wasps, lice, fleas and ants, as well as members of the Arachnidae such as ticks and mitesorder, class or familiy of Acarina (ticks and mites) e.g. representatives of the families Argasidae, Dermanyssidae, Ixodidae, Psoroptidae or Sarcoptidae and representatives of the species *Amblyomma* spp., *Anocentor* spp., *Argas* spp., *Boophilus* spp., *Cheyletiella* spp., *Chorioptes* spp., *Demodex* spp., *Dermacentor* spp., *Dermanyssus* spp., *Haemophysalis* spp., *Hyalomma* spp., *Ixodes* spp., *Lynxacarus* spp., *Mesostigmata* spp., *Notoedres* spp., *Ornithodoros* spp., *Ornithonyssus* spp., *Otobius* spp., *otodectes* spp. *Pneumonyssus* spp., *Psoroptes* spp., *Rhipicephalus* spp., *Sarcoptes* spp., or *Trombicula* spp. Anoplura (sucking and biting lice) e.g. representatives of the species *Bovicola* spp., *Haematopinus* spp., *Linognathus* spp., *Menopon* spp., *Pediculus* spp., *Pemphigus* spp., *Phylloxera* spp., or *Solenopotes* spp.; Diptera (flies) e.g. representatives of the species *Aedes* spp., *Anopheles* spp., *Calliphora* spp., *Chrysomyia* spp., *Chrysops* spp., *Cochliomyia* spp., *Culex* spp., *Culicoides* spp., *Cuterebra* spp., *Dermatobia* spp., *Gastrophilus* spp., *Glossina* spp., *Haematobia* spp., *Haematopota* spp., *Hippobosca* spp., *Hypoderma* spp., *Lucilia* spp., *Lyperosia* spp., *Melophagus* spp., *Oestrus* spp., *Phaenicia* spp., *Phlebotomus* spp., *Phormia* spp., *Sarcophaga* spp., *Simulium* spp., *Stomoxys* spp., *Tabanus* spp., *Tannia* spp. or *Tipula* spp.; *Mallophaga* (biting lice) e.g. representatives of the species *Damalina* spp., *Felicola* spp., *Heterodoxus* spp. or *Trichodectes* spp.; or Siphonaptera (wingless insects) e.g. representatives of the species *Ceratophyllus* spp., spp., *Pulex* spp., or *Xenopsylla* spp; *Cimicidae* (true bugs) e.g. representatives of the species *Cimex* spp., *Tritominae* spp., *Rhodinius* spp., or *Triatoma* spp. and (3) an insect that causes unwanted damage to substrates or materials, such as insects that attack foodstuffs, seeds, wood, paint, plastic, clothing etc.

(4) an insect or arachnid relevant for public health and hygiene, including household insects and ecto-parasites such as, by way of example and not limitation, flies, spider mites, thrips, ticks, red poultry mite, ants, cockroaches, termites, crickets including house-crickets, silverfish, booklice, beetles, earwigs, mosquitos and fleas. More preferred targets are cockroaches (Blattodea) such as but not limited to *Blatella* spp. (e.g. *Blatella germanica* (german cockroach)), *Periplaneta* spp. (e.g. *Periplaneta americana* (American cockroach) and *Periplaneta australiasiae* (Australian cockroach)), *Blatta* spp. (e.g. *Blatta orientalis* (Oriental cockroach)) and *Supella* spp. (e.g. *Supella longipalpa* (brown-banded cockroach); ants (Formicoidea), such as but not limited to *Solenopsis* spp. (e.g. *Solenopsis invicta* (Red Fire Ant)), *Monomorium* spp. (e.g. *Monomorium pharaonis* (Pharaoh Ant)), *Camponotus* spp. (e.g. *Camponotus* spp (Carpenter Ants)), *lasius* spp. (e.g. *lasius niger* (Small Black Ant)), *Tetramorium* spp. (e.g. *Tetramorium caespitum* (Pavement Ant)), *Myrmica* spp. (e.g. *Myrmica rubra* (Red Ant)), *Formica* spp (wood ants), *Crematogaster* spp. (e.g. *Crematogaster lineolata* (Acrobat Ant)), *Iridomyrmex* spp. (e.g. *Iridomyrmex humilis* (Argentine Ant)), *Pheidole* spp. (Big Headed Ants), and *Dasymutilla* spp. (e.g. *Dasymutilla occidentalis* (Velvet Ant)); termites (*Isoptera* and/or *Termitidae*) such as but not limited to *Amitermes* spp. (e.g. *Amitermes floridensis* (Florida dark-winged subterranean termite)), *Reticulitermes* spp. (e.g. *Reticulitermes flavipes* (the eastern subterranean termite), *Reticulitermes hesperus* (Western Subterranean Termite)), *Coptotermes* spp. (e.g. *Coptotermes formosanus* (Formosan Subterranean Termite)), *Incisitermes* spp. (e.g. *Incisitermes minor* (Western Drywood Termite)), *Neotermes* spp. (e.g. *Neotermes connexus* (Forest Tree Termite)).

In terms of "susceptible organisms", which benefit from the present invention, any organism which is susceptible to pest infestation is included. Pests of many different organisms, for example animals such as humans, domestic animals (such as pets like cats, dogs etc) and livestock (including sheep, cows, pigs, chickens etc.).

In this context, preferred, but non-limiting, embodiments of the invention the insect or arachnid is chosen from the group consisting of:
   (1) Acari: mites including *Ixodida* (ticks)
   (2) Arachnida: Araneae (spiders) and Opiliones (harvestman), examples include: *Latrodectus mactans* (black widow) and *Loxosceles recluse* (Brown Recluse Spider)
   (3) Anoplura: lice, such as *Pediculus humanus* (human body louse)

(4) Blattodea: cockroaches including German cockroach (*Blatella germanica*), of the genus *Periplaneta*, including American cockroach (*Periplaneta americana*) and Australian cockroach (*Periplaneta australiasiae*), of the genus *Blatta*, including Oriental cockroach (*Blatta orientalis*) and of the genus *Supella*, including brown-banded cockroach (*Supella longipalpa*). A most preferred target is German cockroach (*Blatella germanica*).

(5) Coleoptera: beetles, examples include: the family of Powderpost beetle (family of Bostrichoidea); *Dendroctonus* spp. (Black Turpentine Beetle, Southern Pine Beetle, IPS Engraver Beetle); Carpet Beetles (*Anthrenus* spp, *Attagenus* spp); Old House Borer (family of Cerambycidae: *Hylotrupes bajulus*); *Anobium punctatum*; *Tribolium* spp (flour beetle); *Trogoderma granarium* (Khapra Beetle); *Oryzaephilus sarinamensis* (Toothed Grain Beetle) etc. (Bookworm)

(6) Dermaptera: family of earwigs (7) Diptera: mosquitoes (Culicidae) and flies (Brachycera), examples are: Anophelinae such as *Anopheles* spp. and Culicinae such as *Aedes fulvus*; Tabanidae such as *Tabanus punctifer* (Horse Fly), *Glossina morsitans morsitans* (tsetse fly), drain flies (Psychodidae) and Calyptratae such as *Musca domestica* (House fly), flesh flies (family of Sarcophagidae) etc.

(8) Heteroptera: bugs, such as *Cimex lectularius* (bed bug)

(9) Hymenoptera: wasps (Apocrita), including ants (Formicoidea), bees (Apoidea): *Solenopsis invicta* (Red Fire Ant), *Monomorium pharaonis* (Pharaoh Ant), *Camponotus* spp (Carpenter Ants), *lasius niger* (Small Black Ant), *tetramorium caespitum* (Pavement Ant), *Myrmica rubra* (Red Ant), *Formica* spp (wood ants), *Crematogaster lineolata* (Acrobat Ant), *Iridomyrmex humilis* (Argentine Ant), *Pheidole* spp. (Big Headed Ants, *Dasymutilla occidentalis* (Velvet Ant) etc.

(10) Isoptera: termites, examples include: *Amitermes floridensis* (Florida dark-winged subterranean termite), the eastern subterranean termite (*Reticulitermes flavipes*), the *R. hesperus* (Western Subterranean Termite), *Coptotermes formosanus* (Formosan Subterranean Termite), *Incisitermes minor* (Western Drywood Termite), *Neotermes connexus* (Forest Tree Termite) and Termitidae

(11) Lepidoptera: moths, examples include: Tineidae & Oecophoridae such as *Tineola bisselliella* (Common Clothes Moth), and Pyralidae such as *Pyralis farinalis* (Meal Moth) etc

(12) Psocoptera: booklice (Psocids)

(13) Siphonaptera: fleas such as *Pulex irritans*

(14) Sternorrhyncha: aphids (Aphididae)

(15) Zygentoma: silverfish, examples are: *Thermobia domestica* and *Lepisma saccharina*

Preferred plant pathogenic insects according to the invention are plant pest and are selected from the group consisting of *Leptinotarsa* spp. (e.g. *L. decemlineata* (Colorado potato beetle), *L. juncta* (false potato beetle), or *L. texana* (Texan false potato beetle)); *Nilaparvata* spp. (e.g. *N. lugens* (brown planthopper)); *Laodelphax* spp. (e.g. *L. striatellus* (small brown planthopper)); *Nephotettix* spp. (e.g. *N. virescens* or *N. cincticeps* (green leafhopper), or *N. nigropictus* (rice leafhopper)); *Sogatella* spp. (e.g. *S. furcifera* (white-backed planthopper)); *Chilo* spp. (e.g. *C. suppressalis* (rice striped stem borer), *C. auricilius* (gold-fringed stem borer), or *C. polychrysus* (dark-headed stem borer)); *Sesamia* spp. (e.g. *S. inferens* (pink rice borer)); *Tryporyza* spp. (e.g. *T. innotata* (white rice borer), or *T. incertulas* (yellow rice borer)); *Diabrotica* spp. (e.g. *D. virgifera virgifera* (western corn rootworm), *D. barberi* (northern corn rootworm), *D. undecimpunctata howardi* (southern corn rootworm), *D. virgifera zeae* (Mexican corn rootworm); *Ostrinia* spp. (e.g. *O. nubilalis* (European corn borer)); *Anaphothrips* spp. (e.g. *A. obscrurus* (grass thrips)); *Pectinophora* spp. (e.g. *P. gossypiella* (pink bollworm)); *Heliothis* spp. (e.g. *H. virescens* (tobacco budworm)); *Trialeurodes* spp. (e.g. *T. abutiloneus* (banded-winged whitefly) *T. vaporariorum* (greenhouse whitefly)); *Bemisia* spp. (e.g. *B. argentifolii* (silverleaf whitefly)); *Aphis* spp. (e.g. *A. gossypii* (cotton aphid)); *Lygus* spp. (e.g. *L. lineolaris* (tarnished plant bug) or *L. hesperus* (western tarnished plant bug)); *Euschistus* spp. (e.g. *E. conspersus* (conperse stink bug)); *Chlorochroa* spp. (e.g. *C. sayi* (Say stinkbug)); *Nezara* spp. (e.g. *N. viridula* (southern green stinkbug)); *Thrips* spp. (e.g. *T. tabaci* (onion thrips)); *Frankliniella* spp. (e.g. *F. fusca* (tobacco thrips), or *F. occidentalis* (western flower thrips)); *Myzus* spp. (e.g. *M. persicae* (green peach aphid)); *Macrosiphum* spp. (e.g. *M. euphorbiae* (potato aphid)); *Blissus* spp. (e.g. *B. leucopterus leucopterus* (chinch bug)); *Acrosternum* spp. (e.g. *A. hilare* (green stink bug)); *Chilotraea* spp. (e.g. *C. polychrysa* (rice stalk borer)); *Lissorhoptrus* spp. (e.g. *L. oryzophilus* (rice water weevil)); *Rhopalosiphum* spp. (e.g. *R. maidis* (corn leaf aphid)); and *Anuraphis* spp. (e.g. *A. maidiradicis* (corn root aphid)).

According to a more specific embodiment, the methods of the invention are applicable for *Leptinotarsa* species. *Leptinotarsa* belong to the family of *Chrysomelidae* or leaf beetles. Chrysomelid beetles such as Flea Beetles and Corn Rootworms and Curculionids such as Alfalfa Weevils are particularly important pests. Flea Beetles include a large number of small leaf feeding beetles that feed on the leaves of a number of grasses, cereals and herbs. Flea Beetles include a large number of genera (e.g., *Attica, Apphthona, Argopistes, Disonycha, Epitrix, Longitarsus, Prodagricomela, Systena*, and *Phyllotreta*). The Flea Beetle, *Phyllotreta cruciferae*, also known as the Rape Flea Beetle, is a particularly important pest. Corn rootworms include species found in the genus *Diabrotica* (e.g., *D. undecimpunctata undecimpunctata, D. undecimpunctata howardii, D. longicornis, D. virgifera* and *D. balteata*). Corn rootworms cause extensive damage to corn and curcubits. The Western Spotted Cucumber Beetle, *D. undecimpunctata undecimpunctata*, is a pest of curcubits in the western U.S. Alfalfa weevils (also known as clover weevils) belong to the genus, *Hypera* (*H. postica, H. brunneipennis, H. nigrirostris, H. punctata* and *H. meles*), and are considered an important pest of legumes. The Egyptian alfalfa weevil, *H. brunneipennis*, is an important pest of alfalfa in the western U.S.

There are more than 30 *Leptinotarsa* species. The present invention thus encompasses methods for controlling *Leptinotarsa* species, more specific methods for killing insects, or preventing *Leptinotarsa* insects to develop or to grow, or preventing insects to infect or infest. Specific *Leptinotarsa* species to control according to the invention include Colorado Potato Beetle (*Leptinotarsa decemlineata* (Say) and False Potato Beetle (*Leptinotarsa juncta* (Say).

CPB is a (serious) pest on our domestic potato (*Solanum tuberosum*), other cultivated and wild tuber bearing and non-tuber bearing potato species (e.g. *S. demissum, S. phureja* a.o.) and other Solanaceous (nightshades) plant species incuding:

(a) the crop species tomato (several *Lycopersicon* species), eggplant (*Solanum melongena*), peppers (several *Capsicum* species), tobacco (several *Nicotiana* species including ornamentals) and ground cherry (*Physalis* species);

(b) the weed/herb species, horse nettle (*S. carolinense*), common nightshade (*S. dulcamara*), belladonna (*Atropa* species), thorn apple (*datura* species), henbane (*Hyoscyamus* species) and buffalo burr (*S. rostratum*).

FPB is primarily found on horse nettle, but also occurs on common nightshade, ground cherry, and husk tomato (*Physalis* species).

The term "insect" encompasses insects of all types and at all stages of development, including egg, larval or nymphal, pupal and adult stages.

The present invention extends to methods as described herein, wherein the insect is *Leptinotarsa decemlineata* (Colorado potato beetle) and the plant is potato, eggplant, tomato, pepper, tobacco, ground cherry or rice, corn or cotton.

The present invention extends to methods as described herein, wherein the insect is *Phaedon cochleariae* (mustard leaf beetle) and the plant is mustard, chinese cabbage, turnip greens, collard greens or bok Choy.

The present invention extends to methods as described herein, wherein the insect is *Epilachna varivetis* (Mexican bean beetle) and the plant is bean, field bean, garden bean, snap bean, lima bean, mung bean, string bean, black-eyed bean, velvet bean, soybean, cowpea, pigeon pea, clover or alfalfa.

The present invention extends to methods as described herein, wherein the insect is *Anthonomus grandis* (cotton boll weevil) and the plant is cotton.

The present invention extends to methods as described herein, wherein the insect is *Tribolium castaneum* (red flour beetle) and the plant is in the form of stored grain products such as flour, cereals, meal, crackers, beans, spices, pasta, cake mix, dried pet food, dried flowers, chocolate, nuts, seeds, and even dried museum specimens.

The present invention extends to methods as described herein, wherein the insect is *Myzus persicae* (green peach aphid) and the plant is a tree such as *Prunus*, particularly peach, apricot and plum; a vegetable crop of the families Solanaceae, Chenopodiaceae, Compositae, Cruciferae, and Cucurbitaceae, including but not limited to, artichoke, asparagus, bean, beets, broccoli, Brussels sprouts, cabbage, carrot, cauliflower, cantaloupe, celery, corn, cucumber, fennel, kale, kohlrabi, turnip, eggplant, lettuce, mustard, okra, parsley, parsnip, pea, pepper, potato, radish, spinach, squash, tomato, turnip, watercress, and watermelon; a field crops such as, but not limited to, tobacco, sugar beet, and sunflower; a flower crop or other ornamental plant.

The present invention extends to methods as described herein, wherein the insect is *Nilaparvata lugens* and the plant is a rice plant.

The present invention extends to methods as described herein, wherein the insect is *Chilo suppressalis* (rice striped stem borer) and the plant is a rice plant, barley, sorghum, maize, wheat or a grass.

The present invention extends to methods as described herein, wherein the insect is *Plutella xylostella* (Diamondback moth) and the plant is a *Brassica* species such as, but not limited to cabbage, chinese cabbage, Brussels sprouts, kale, rapeseed, broccoli, cauliflower, turnip, mustard or radish.

The present invention extends to methods as described herein, wherein the insect is *Acheta domesticus* (house cricket) and the plant is any plant as described herein or any organic matter.

In this context the term "plant" encompasses any plant material that it is desired to treat to prevent or reduce insect growth and/or insect infestation. This includes, inter alia, whole plants, seedlings, propagation or reproductive material such as seeds, cuttings, grafts, explants, etc. and also plant cell and tissue cultures. The plant material should express, or have the capability to express, the RNA molecule comprising at least one nucleotide sequence that is the RNA complement of or that represents the RNA equivalent of at least part of the nucleotide sequence of the sense strand of at least one target gene of the pest organism, such that the RNA molecule is taken up by a pest upon plant-pest interaction, said RNA molecule being capable of inhibiting the target gene or down-regulating expression of the target gene by RNA interference.

The target gene may be any of the target genes herein described, for instance a target gene that is essential for the viability, growth, development or reproduction of the pest. The present invention relates to any gene of interest in the insect (which may be referred to herein as the "target gene") that can be down-regulated.

The terms "down-regulation of gene expression" and "inhibition of gene expression" are used interchangeably and refer to a measurable or observable reduction in gene expression or a complete abolition of detectable gene expression, at the level of protein product and/or mRNA product from the target gene. Preferably the down-regulation does not substantially directly inhibit the expression of other genes of the insect. The down-regulation effect of the dsRNA on gene expression may be calculated as being at least 30%, 40%, 50%, 60%, preferably 70%, 80% or even more preferably 90% or 95% when compared with normal gene expression. Depending on the nature of the target gene, down-regulation or inhibition of gene expression in cells of an insect can be confirmed by phenotypic analysis of the cell or the whole insect or by measurement of mRNA or protein expression using molecular techniques such as RNA solution hybridization, PCR, nuclease protection, Northern hybridization, reverse transcription, gene expression monitoring with a microarray, antibody binding, enzyme-linked immunosorbent assay (ELISA), Western blotting, radioimmunoassay (RIA), other immunoassays, or fluorescence-activated cell analysis (FACS).

The "target gene" may be essentially any gene that is desirable to be inhibited because it interferes with growth or pathogenicity or infectivity of the insect. For instance, if the method of the invention is to be used to prevent insect growth and/or infestation then it is preferred to select a target gene which is essential for viability, growth, development or reproduction of the insect, or any gene that is involved with pathogenicity or infectivity of the insect, such that specific inhibition of the target gene leads to a lethal phenotype or decreases or stops insect infestation.

According to one non-limiting embodiment, the target gene is such that when its expression is down-regulated or inhibited using the method of the invention, the insect is killed, or the reproduction or growth of the insect is stopped or retarded. This type of target genes is considered to be essential for the viability of the insect and is referred to as essential genes. Therefore, the present invention encompasses a method as described herein, wherein the target gene is an essential gene.

According to a further non-limiting embodiment, the target gene is such that when it is down-regulated using the method of the invention, the infestation or infection by the insect, the damage caused by the insect, and/or the ability of the insect to infest or infect host organisms and/or cause such damage, is reduced. The terms "infest" and "infect" or "infestation" and "infection" are generally used interchangeably throughout. This type of target genes is considered to be involved in the pathogenicity or infectivity of the insect. Therefore, the present invention extends to methods as described herein, wherein the target gene is involved in the pathogenicity or infectivity of the insect. The advantage of choosing the latter type of target gene is that the insect is blocked to infect further plants or plant parts and is inhibited to form further generations.

According to one embodiment, target genes are conserved genes or insect-specific genes.

In addition, any suitable double-stranded RNA fragment capable of directing RNAi or RNA-mediated gene silencing or inhibition of an insect target gene may be used in the methods of the invention.

In another embodiment, a gene is selected that is essentially involved in the growth, development, and reproduction of a pest, (such as an insect). Exemplary genes include but are not limited to the structural subunits of ribosomal proteins and a beta-coatamer gene, such as the CHD3 gene. Ribosomal proteins such as S4 (RpS4) and S9(RpS9) are structural constituents of the ribosome involved in protein biosynthesis and which are components of the cytosolic small ribosomal subunit, the ribosomal proteins such as L9 and L19 are structural constituent of ribosome involved in protein biosynthesis which is localised to the ribosome. The beta coatamer gene in *C. elegans* encodes a protein which is a subunit of a multimeric complex that forms a membrane vesicle coat. Similar sequences have been found in diverse organisms such as *Arabidopsis thaliana*, *Drosophila melanogaster*, and *Saccharomyces cerevisiae*. Related sequences are found in diverse organisms such as *Leptinotarsa decemlineata*, *Phaedon cochleariae*, *Epilachna varivestis*, *Anthonomus grandis*, *Tribolium castaneum*, *Myzus persicae*, *Nilaparvata lugens*, *Chilo suppressalis*, *Plutella xylostella* and *Acheta domesticus*.

Other target genes for use in the present invention may include, for example, those that play important roles in viability, growth, development, reproduction, and infectivity. These target genes include, for example, house keeping genes, transcription factors, and pest specific genes or lethal knockout mutations in *Caenorhabditis* or *Drosophila*. The target genes for use in the present invention may also be those that are from other organisms, e.g., from insects or arachnidae (e.g. *Leptinotarsa* spp., *Phaedon* spp., *Epilachna* spp., *Anthonomus* spp., *Tribolium* spp., *Myzus* spp., *Nilaparvata* spp., *Chilo* spp., *Plutella* spp., or *Acheta* spp.).

Preferred target genes include those specified in Table 1A and orthologous genes from other target organisms, such as from other pest organisms.

In the methods of the present invention, dsRNA is used to inhibit growth or to interfere with the pathogenicity or infectivity of the insect.

The invention thus relates to isolated double-stranded RNA comprising annealed complementary strands, one of which has a nucleotide sequence which is complementary to at least part of a target nucleotide sequence of a target gene of an insect. The target gene may be any of the target genes described herein, or a part thereof that exerts the same function.

According to one embodiment of the present invention, an isolated double-stranded RNA is provided comprising annealed complementary strands, one of which has a nucleotide sequence which is complementary to at least part of a nucleotide sequence of an insect target gene, wherein said target gene comprises a sequence which is selected from the group comprising:
(i) sequences which are at least 75% identical to a sequence represented by any of SEQ ID NOs 1, 3, 5, 7, 9, 11, 13, 15, 17, 19, 21, 23, 49 to 158, 159, 160-163, 168, 173, 178, 183, 188, 193, 198, 203, 208, 215, 220, 225, 230, 247, 249, 251, 253, 255, 257, 259, 275 to 472, 473, 478, 483, 488, 493, 498, 503, 513, 515, 517, 519, 521, 533 to 575, 576, 581, 586, 591, 596, 601, 603, 605, 607, 609, 621 to 767, 768, 773, 778, 783, 788, 793, 795, 797, 799, 801, 813 to 862, 863, 868, 873, 878, 883, 888, 890, 892, 894, 896, 908 to 1040, 1041, 1046, 1051, 1056, 1061, 1071, 1073, 1075, 1077, 1079, 1081, 1083, 1085, 1087, 1089, 1091, 1093, 1095, 1097, 1099, 1101, 1103, 1105, 1107, 1109, 1111, 1113, 1161 to 1571, 1572, 1577, 1582, 1587, 1592, 1597, 1602, 1607, 1612, 1617, 1622, 1627, 1632, 1637, 1642, 1647, 1652, 1657, 1662, 1667, 1672, 1677, 1682, 1684, 1686, 1688, 1690, 1692, 1694, 1696, 1698, 1700, 1702, 1704, 1730 to 2039, 2040, 2045, 2050, 2055, 2060, 2065, 2070, 2075, 2080, 2085, 2090, 2095, 2100, 2102, 2104, 2106, 2108, 2120 to 2338, 2339, 2344, 2349, 2354, 2359, 2364, 2366, 2368, 2370, 2372, 2384 to 2460, 2461, 2466, 2471, 2476, 2481, 2487, 2488, 2493 or 2495, or the complement thereof, and (ii) sequences comprising at least 17 contiguous nucleotides of any of SEQ ID NOs 1, 3, 5, 7, 9, 11, 13, 15, 17, 19, 21, 23, 49 to 158, 159, 160-163, 168, 173, 178, 183, 188, 193, 198, 203, 208, 215, 220, 225, 230, 247, 249, 251, 253, 255, 257, 259, 275 to 472, 473, 478, 483, 488, 493, 498, 503, 513, 515, 517, 519, 521, 533 to 575, 576, 581, 586, 591, 596, 601, 603, 605, 607, 609, 621 to 767, 768, 773, 778, 783, 788, 793, 795, 797, 799, 801, 813 to 862, 863, 868, 873, 878, 883, 888, 890, 892, 894, 896, 908 to 1040, 1041, 1046, 1051, 1056, 1061, 1071, 1073, 1075, 1077, 1079, 1081, 1083, 1085, 1087, 1089, 1091, 1093, 1095, 1097, 1099, 1101, 1103, 1105, 1107, 1109, 1111, 1113, 1161 to 1571, 1572, 1577, 1582, 1587, 1592, 1597, 1602, 1607, 1612, 1617, 1622, 1627, 1632, 1637, 1642, 1647, 1652, 1657, 1662, 1667, 1672, 1677, 1682, 1684, 1686, 1688, 1690, 1692, 1694, 1696, 1698, 1700, 1702, 1704, 1730 to 2039, 2040, 2045, 2050, 2055, 2060, 2065, 2070, 2075, 2080, 2085, 2090, 2095, 2100, 2102, 2104, 2106, 2108, 2120 to 2338, 2339, 2344, 2349, 2354, 2359, 2364, 2366, 2368, 2370, 2372, 2384 to 2460, 2461, 2466, 2471, 2476, 2481, 2487, 2488, 2493 or 2495, or the complement thereof, or wherein said insect target gene is an insect orthologue of a gene comprising at least 17 contiguous nucleotides of any of SEQ ID NOs 49 to 158, 275 to 472, 533 to 575, 621 to 767, 813 to 862, 908 to 1040, 1161 to 1571, 1730 to 2039, 2120 to 2338, 2384 to 2460, or the complement thereof.

Depending on the assay used to measure gene silencing, the growth inhibition can be quantified as being greater than about 5%, 10%, more preferably about 20%, 25%, 33%, 50%, 60%, 75%, 80%, most preferably about 90%, 95%, or about 99% as compared to a pest organism that has been treated with control dsRNA.

According to another embodiment of the present invention, an isolated double-stranded RNA is provided, wherein at least one of said annealed complementary strands comprises the RNA equivalent of at least one of the nucleotide sequences represented by any of SEQ ID NOs 1, 3, 5, 7, 9, 11, 13, 15, 17, 19, 21, 23, 49 to 158, 159, 160-163, 168, 173, 178, 183, 188, 193, 198, 203, 208, 215, 220, 225, 230, 247, 249, 251, 253, 255, 257, 259, 275 to 472, 473, 478, 483, 488, 493, 498, 503, 513, 515, 517, 519, 521, 533 to 575, 576, 581, 586, 591, 596, 601, 603, 605, 607, 609, 621 to 767, 768, 773, 778, 783, 788, 793, 795, 797, 799, 801, 813 to 862, 863, 868, 873, 878, 883, 888, 890, 892, 894, 896, 908 to 1040, 1041, 1046, 1051, 1056, 1061, 1071, 1073, 1075, 1077, 1079, 1081, 1083, 1085, 1087, 1089, 1091, 1093, 1095, 1097, 1099, 1101, 1103, 1105, 1107, 1109, 1111, 1113, 1161 to 1571, 1572, 1577, 1582, 1587, 1592, 1597, 1602, 1607, 1612, 1617, 1622, 1627, 1632, 1637, 1642, 1647, 1652, 1657, 1662, 1667, 1672, 1677, 1682, 1684, 1686, 1688, 1690, 1692, 1694, 1696, 1698, 1700, 1702, 1704, 1730 to 2039, 2040, 2045, 2050, 2055, 2060, 2065, 2070, 2075, 2080, 2085, 2090, 2095, 2100, 2102, 2104, 2106, 2108, 2120 to 2338, 2339, 2344, 2349, 2354, 2359, 2364, 2366, 2368, 2370, 2372, 2384 to 2460, 2461, 2466, 2471, 2476, 2481, 2487, 2488, 2489, 2493 or 2495, or wherein at least one of said annealed complementary strands comprises the RNA equivalent of a fragment of at least 17 basepairs in length thereof, preferably at least 18, 19, 20 or 21, more preferably at least 22, 23 or 24 basepairs in length thereof.

If the method of the invention is used for specifically controlling growth or infestation of a specific insect in or on a host cell or host organism, it is preferred that the double-stranded RNA does not share any significant homology with any host gene, or at least not with any essential gene of the host. In this context, it is preferred that the double-stranded RNA shows less than 30%, more preferably less that 20%, more preferably less than 10%, and even more preferably less than 5% nucleic acid sequence identity with any gene of the host cell. % sequence identity should be calculated across the full length of the double-stranded RNA region. If genomic sequence data is available for the host organism one may cross-check sequence identity with the double-stranded RNA using standard bioinformatics tools. In one embodiment, there is no sequence identity between the dsRNA and a host sequences over 21 contiguous nucleotides, meaning that in this context, it is preferred that 21 contiguous base pairs of the dsRNA do not occur in the genome of the host organism. In another embodiment, there is less than about 10% or less than about 12.5% sequence identity over 24 contiguous nucleotides of the dsRNA with any nucleotide sequence from a host species.

The double-stranded RNA comprises annealed complementary strands, one of which has a nucleotide sequence which corresponds to a target nucleotide sequence of the target gene to be down-regulated. The other strand of the double-stranded RNA is able to base-pair with the first strand.

The expression "target region" or "target nucleotide sequence" of the target insect gene may be any suitable region or nucleotide sequence of the gene. The target region should comprise at least 17, at least 18 or at least 19 consecutive nucleotides of the target gene, more preferably at least 20 or at least 21 nucleotide and still more preferably at least 22, 23 or 24 nucleotides of the target gene.

It is preferred that (at least part of) the double-stranded RNA will share 100% sequence identity with the target region of the insect target gene. However, it will be appreciated that 100% sequence identity over the whole length of the double stranded region is not essential for functional RNA inhibition. RNA sequences with insertions, deletions, and single point mutations relative to the target sequence have also been found to be effective for RNA inhibition. The terms "corresponding to" or "complementary to" are used herein interchangeable, and when these terms are used to refer to sequence correspondence between the double-stranded RNA and the target region of the target gene, they are to be interpreted accordingly, i.e. as not absolutely requiring 100% sequence identity. However, the % sequence identity between the double-stranded RNA and the target region will generally be at least 80% or 85% identical, preferably at least 90%, 95%, 96%, or more preferably at least 97%, 98% and still more preferably at least 99%. Two nucleic acid strands are "substantially complementary" when at least 85% of their bases pair.

The term "complementary" as used herein relates to both DNA-DNA complementarity as to DNA-RNA complementarity. In analogy herewith, the term "RNA equivalent" substantially means that in the DNA sequence(s), the base "T" may be replaced by the corresponding base "U" normally present in ribonucleic acids.

Although the dsRNA contains a sequence which corresponds to the target region of the target gene it is not absolutely essential for the whole of the dsRNA to correspond to the sequence of the target region. For example, the dsRNA may contain short non-target regions flanking the target-specific sequence, provided that such sequences do not affect performance of the dsRNA in RNA inhibition to a material extent.

The dsRNA may contain one or more substitute bases in order to optimise performance in RNAi. It will be apparent to the skilled reader how to vary each of the bases of the dsRNA in turn and test the activity of the resulting dsRNAs (e.g. in a suitable in vitro test system) in order to optimise the performance of a given dsRNA.

The dsRNA may further contain DNA bases, non-natural bases or non-natural backbone linkages or modifications of the sugar-phosphate backbone, for example to enhance stability during storage or enhance resistance to degradation by nucleases.

It has been previously reported that the formation of short interfering RNAs (siRNAs) of about 21 bp is desirable for effective gene silencing. However, in applications of applicant it has been shown that the minimum length of dsRNA preferably is at least about 80-100 bp in order to be efficiently taken up by certain pest organisms. There are indications that in invertebrates such as the free living nematode *C. elegans* or the plant parasitic nematode *Meloidogyne incognita*, these longer fragments are more effective in gene silencing, possibly due to a more efficient uptake of these long dsRNA by the invertebrate.

It has also recently been suggested that synthetic RNA duplexes consisting of either 27-mer blunt or short hairpin (sh) RNAs with 29 bp stems and 2-nt 3' overhangs are more potent inducers of RNA interference than conventional 21-mer siRNAs. Thus, molecules based upon the targets identified above and being either 27-mer blunt or short hairpin (sh) RNAs with 29-bp stems and 2-nt 3' overhangs are also included within the scope of the invention.

Therefore, in one embodiment, the double-stranded RNA fragment (or region) will itself preferably be at least 17 bp in length, preferably 18 or 19 bp in length, more preferably at least 20 bp, more preferably at least 21 bp, or at least 22 bp, or at least 23 bp, or at least 24 bp, 25 bp, 26 bp or at least 27 bp in length. The expressions "double-stranded RNA fragment" or "double-stranded RNA region" refer to a small entity of the double-stranded RNA corresponding with (part of) the target gene.

Generally, the double stranded RNA is preferably between about 17-1500 bp, even more preferably between about 80-1000 bp and most preferably between about 17-27 bp or between about 80-250 bp; such as double stranded RNA regions of about 17 bp, 18 bp, 19 bp, 20 bp, 21 bp, 22 bp, 23 bp, 24 bp, 25 bp, 27 bp, 50 bp, 80 bp, 100 bp, 150 bp, 200 bp, 250 bp, 300 bp, 350 bp, 400 bp, 450 bp, 500 bp, 550 bp, 600 bp, 650 bp, 700 bp, 900 bp, 100 bp, 1100 bp, 1200 bp, 1300 bp, 1400 bp or 1500 bp.

The upper limit on the length of the double-stranded RNA may be dependent on i) the requirement for the dsRNA to be taken up by the insect and ii) the requirement for the dsRNA to be processed within the cell into fragments that direct RNAi. The chosen length may also be influenced by the method of synthesis of the RNA and the mode of delivery of the RNA to the cell. Preferably the double-stranded RNA to be used in the methods of the invention will be less than 10,000 bp in length, more preferably 1000 bp or less, more preferably 500 bp or less, more preferably 300 bp or less, more preferably 100 bp or less. For any given target gene and insect, the optimum length of the dsRNA for effective inhibition may be determined by experiment.

The double-stranded RNA may be fully or partially double-stranded. Partially double-stranded RNAs may include short single-stranded overhangs at one or both ends of the double-stranded portion, provided that the RNA is still capable of being taken up by insects and directing RNAi. The double-stranded RNA may also contain internal non-complementary regions.

The methods of the invention encompass the simultaneous or sequential provision of two or more different double-stranded RNAs or RNA constructs to the same insect, so as to achieve down-regulation or inhibition of multiple target genes or to achieve a more potent inhibition of a single target gene.

Alternatively, multiple targets are hit by the provision of one double-stranded RNA that hits multiple target sequences, and a single target is more efficiently inhibited by the presence of more than one copy of the double stranded RNA fragment corresponding to the target gene. Thus, in one embodiment of the invention, the double-stranded RNA construct comprises multiple dsRNA regions, at least one strand of each dsRNA region comprising a nucleotide sequence that is complementary to at least part of a target nucleotide sequence of an insect target gene. According to the invention, the dsRNA regions in the RNA construct may be complementary to the same or to different target genes and/or the dsRNA regions may be complementary to targets from the same or from different insect species.

The terms "hit", "hits" and "hitting" are alternative wordings to indicate that at least one of the strands of the dsRNA is complementary to, and as such may bind to, the target gene or nucleotide sequence.

In one embodiment, the double stranded RNA region comprises multiple copies of the nucleotide sequence that is complementary to the target gene. Alternatively, the dsRNA hits more than one target sequence of the same target gene. The invention thus encompasses isolated double stranded RNA constructs comprising at least two copies of said nucleotide sequence complementary to at least part of a nucleotide sequence of an insect target.

The term "multiple" in the context of the present invention means at least two, at least three, at least four, at least five, at least six, etc.

The expressions "a further target gene" or "at least one other target gene" mean for instance a second, a third or a fourth, etc. target gene.

DsRNA that hits more than one of the above-mentioned targets, or a combination of different dsRNA against different of the above mentioned targets are developed and used in the methods of the present invention.

Accordingly the invention relates to an isolated double stranded RNA construct comprising at least two copies of the RNA equivalent of at least one of the nucleotide sequences represented by any of SEQ ID NOs 1, 3, 5, 7, 9, 11, 13, 15, 17, 19, 21, 23, 49 to 158, 159, 160-163, 168, 173, 178, 183, 188, 193, 198, 203, 208, 215, 220, 225, 230, 247, 249, 251, 253, 255, 257, 259, 275 to 472, 473, 478, 483, 488, 493, 498, 503, 513, 515, 517, 519, 521, 533 to 575, 576, 581, 586, 591, 596, 601, 603, 605, 607, 609, 621 to 767, 768, 773, 778, 783, 788, 793, 795, 797, 799, 801, 813 to 862, 863, 868, 873, 878, 883, 888, 890, 892, 894, 896, 908 to 1040, 1041, 1046, 1051, 1056, 1061, 1071, 1073, 1075, 1077, 1079, 1081, 1083, 1085, 1087, 1089, 1091, 1093, 1095, 1097, 1099, 1101, 1103, 1105, 1107, 1109, 1111, 1113, 1161 to 1571, 1572, 1577, 1582, 1587, 1592, 1597, 1602, 1607, 1612, 1617, 1622, 1627, 1632, 1637, 1642, 1647, 1652, 1657, 1662, 1667, 1672, 1677, 1682, 1684, 1686, 1688, 1690, 1692, 1694, 1696, 1698, 1700, 1702, 1704, 1730 to 2039, 2040, 2045, 2050, 2055, 2060, 2065, 2070, 2075, 2080, 2085, 2090, 2095, 2100, 2102, 2104, 2106, 2108, 2120 to 2338, 2339, 2344, 2349, 2354, 2359, 2364, 2366, 2368, 2370, 2372, 2384 to 2460, 2461, 2466, 2471, 2476, 2481, 2487, 2488, 2489, 2493 or 2495, or at least two copies of the RNA equivalent of a fragment of at least 17 basepairs in length thereof, preferably at least 18, 19, or 21, more preferably at least 22, 23 or 24 basepairs in length thereof. Preferably, said double-stranded RNA comprises the RNA equivalent of the nucleotide sequence as represented in SEQ ID NO 159 or 160, or a fragment of at least 17, preferably at least 18, 19, 20 or 21, more preferably at least 22, 23 or 24 basepairs in length thereof. In a further embodiment, the invention relates to an an isolated double stranded RNA construct comprising at least two copies of the RNA equivalent of the nucleotide sequence as represented by SEQ ID NO 159 or 160.

Accordingly, the present invention extends to methods as described herein, wherein the dsRNA comprises annealed complementary strands, one of which has a nucleotide sequence which is complementary to at least part of a target nucleotide sequence of an insect target gene, and which comprises the RNA equivalents of at least two nucleotide sequences independently chosen from each other. In one embodiment, the dsRNA comprises the RNA equivalents of at least two, preferably at least three, four or five, nucleotide sequences independently chosen from the sequences represented by any of SEQ ID NOs 1, 3, 5, 7, 9, 11, 13, 15, 17, 19, 21, 23, 49 to 158, 159, 160-163, 168, 173, 178, 183, 188, 193, 198, 203, 208, 215, 220, 225, 230, 247, 249, 251, 253, 255, 257, 259, 275 to 472, 473, 478, 483, 488, 493, 498, 503, 513, 515, 517, 519, 521, 533 to 575, 576, 581, 586, 591, 596, 601, 603, 605, 607, 609, 621 to 767, 768, 773, 778, 783, 788, 793, 795, 797, 799, 801, 813 to 862, 863, 868, 873, 878, 883, 888, 890, 892, 894, 896, 908 to 1040, 1041, 1046, 1051, 1056, 1061, 1071, 1073, 1075, 1077, 1079, 1081, 1083, 1085, 1087, 1089, 1091, 1093, 1095, 1097, 1099, 1101, 1103, 1105, 1107, 1109, 1111, 1113, 1161 to 1571, 1572, 1577, 1582, 1587, 1592, 1597, 1602, 1607, 1612, 1617, 1622, 1627, 1632, 1637, 1642, 1647, 1652, 1657, 1662, 1667, 1672, 1677, 1682, 1684, 1686, 1688, 1690, 1692, 1694, 1696, 1698, 1700, 1702, 1704, 1730 to 2039, 2040, 2045, 2050, 2055, 2060, 2065, 2070, 2075, 2080, 2085, 2090, 2095, 2100, 2102, 2104, 2106, 2108, 2120 to 2338, 2339, 2344, 2349, 2354, 2359, 2364, 2366, 2368, 2370, 2372, 2384 to 2460, 2461, 2466, 2471, 2476, 2481, 2487, 2488, 2489, 2493 or 2495, or fragments thereof of at least 17 basepairs in length, preferably at least 18, 19, 20 or 21, more preferably at least 22, 23 or 24 basepairs in length thereof.

The at least two nucleotide sequences may be derived from the target genes herein described. According to one preferred embodiment the dsRNA hits at least one target gene that is essential for viability, growth, development or reproduction of the insect and hits at least one gene involved in pathogenicity or infectivity as described hereinabove. Alternatively, the dsRNA hits multiple genes of the same category, for example, the dsRNA hits at least 2 essential genes or at least 2 genes involved in the same cellular function. According to a further embodiment, the dsRNA hits at least 2 target genes, which target genes are involved in a different cellular function. For example the dsRNA hits two or more genes involved in protein synthesis (e.g. ribosome subunits), intracellular protein transport, nuclear mRNA splicing, or involved in one of the functions described in Table 1A.

Preferably, the present invention extends to methods as described herein, wherein said insect target gene comprises a sequence which is which is selected from the group comprising:
(i) sequences which are at least 75% identical to a sequence represented by any of SEQ ID NOs 1, 3, 5, 7, 9, 11, 13, 15, 17, 19, 21, 23, 49 to 158, 159, 160-163, 168, 173, 178, 183, 188, 193, 198, 203, 208, 215, 220, 225, 230, 247, 249, 251, 253, 255, 257, 259, 275 to 472, 473, 478, 483, 488, 493, 498, 503, 513, 515, 517, 519, 521, 533 to 575, 576, 581, 586, 591, 596, 601, 603, 605, 607, 609, 621 to 767, 768, 773, 778, 783, 788, 793, 795, 797, 799, 801, 813 to 862, 863, 868, 873, 878, 883, 888, 890, 892, 894, 896, 908 to 1040, 1041, 1046, 1051, 1056, 1061, 1071, 1073, 1075, 1077, 1079, 1081, 1083, 1085, 1087, 1089, 1091, 1093, 1095, 1097, 1099, 1101, 1103, 1105, 1107, 1109, 1111, 1113, 1161 to 1571, 1572, 1577, 1582, 1587, 1592, 1597, 1602, 1607, 1612, 1617, 1622, 1627, 1632, 1637, 1642, 1647, 1652, 1657, 1662, 1667, 1672, 1677, 1682, 1684, 1686, 1688, 1690, 1692, 1694, 1696, 1698, 1700, 1702, 1704, 1730 to 2039, 2040, 2045, 2050, 2055, 2060, 2065, 2070, 2075, 2080, 2085, 2090, 2095, 2100, 2102, 2104, 2106, 2108, 2120 to 2338, 2339, 2344, 2349, 2354, 2359, 2364, 2366, 2368, 2370, 2372, 2384 to 2460, 2461, 2466, 2471, 2476, 2481, 2487, 2488, 2493 or 2495, or the complement thereof, and
(ii) sequences comprising at least 17 contiguous nucleotides of any of SEQ ID NOs 1, 3, 5, 7, 9, 11, 13, 15, 17, 19, 21, 23, 49 to 158, 159, 160-163, 168, 173, 178, 183, 188, 193, 198, 203, 208, 215, 220, 225, 230, 247, 249, 251, 253, 255, 257, 259, 275 to 472, 473, 478, 483, 488, 493, 498, 503, 513, 515, 517, 519, 521, 533 to 575, 576, 581, 586, 591, 596, 601, 603, 605, 607, 609, 621 to 767, 768, 773, 778, 783, 788, 793, 795, 797, 799, 801, 813 to 862, 863, 868, 873, 878, 883, 888, 890, 892, 894, 896, 908 to 1040, 1041, 1046, 1051, 1056, 1061, 1071, 1073, 1075, 1077, 1079, 1081, 1083, 1085, 1087, 1089, 1091, 1093, 1095, 1097, 1099, 1101, 1103, 1105, 1107, 1109, 1111, 1113, 1161 to 1571, 1572, 1577, 1582, 1587, 1592, 1597, 1602, 1607, 1612, 1617, 1622, 1627, 1632, 1637, 1642, 1647, 1652, 1657, 1662, 1667, 1672, 1677, 1682, 1684, 1686, 1688, 1690, 1692, 1694, 1696, 1698, 1700, 1702, 1704, 1730 to 2039, 2040, 2045, 2050, 2055, 2060, 2065, 2070, 2075, 2080, 2085, 2090, 2095, 2100, 2102, 2104, 2106, 2108, 2120 to 2338, 2339, 2344, 2349, 2354, 2359, 2364, 2366, 2368, 2370, 2372, 2384 to 2460, 2461, 2466, 2471, 2476, 2481, 2487, 2488, 2493 or 2495, or the complement thereof, or wherein said insect target gene is an insect orthologue of a gene comprising at least 17 contiguous nucleotides of any of SEQ ID NOs 49 to 158, 275 to 472, 533 to 575, 621 to 767, 813 to 862, 908 to 1040, 1161 to 1571, 1730 to 2039, 2120 to 2338, 2384 to 2460, or the complement thereof.

The dsRNA regions (or fragments) in the double stranded RNA may be combined as follows:
a) when multiple dsRNA regions targeting a single target gene are combined, they may be combined in the original order (ie the order in which the regions appear in the target gene) in the RNA construct,
b) alternatively, the original order of the fragments may be ignored so that they are scrambled and combined randomly or deliberately in any order into the double stranded RNA construct,
c) alternatively, one single fragment may be repeated several times, for example from 1 to 10 times, e.g. 1, 2, 3, 4, 5, 6, 7, 8, 9 or 10 times, in the ds RNA construct, or
d) the dsRNA regions (targeting a single or different target genes) may be combined in the sense or antisense orientation.

In addition, the target gene(s) to be combined may be chosen from one or more of the following categories of genes:
e) "essential" genes or "pathogenicity genes" as described above encompass genes that are vital for one or more target insects and result in a lethal or severe (e.g. feeding, reproduction, growth) phenotype when silenced. The choice of a strong lethal target gene results in a potent RNAi effect. In the RNA constructs of the invention, multiple dsRNA regions targeting the same or different (very effective) lethal genes can be combined to further increase the potency, efficacy or speed of the RNAi effect in insect control.
f) "weak" genes encompass target genes with a particularly interesting function in one of the cellular pathways described herein, but which result in a weak phenotypic effect when silenced independently. In the RNA constructs of the invention, multiple dsRNA regions targeting a single or different weak gene(s) may be combined to obtain a stronger RNAi effect.
g) "insect specific" genes encompass genes that have no substantial homologous counterpart in non-insect organisms as can be determined by bioinformatics homology searches, for example by BLAST searches. The choice of an insect specific target gene results in a species specific RNAi effect, with no effect or no substantial (adverse) effect in non-target organisms.
h) "conserved genes" encompass genes that are conserved (at the amino acid level) between the target organism and non-target organism(s). To reduce possible effects on non-target species, such effective but conserved genes are analysed and target sequences from the variable regions of these conserved genes are chosen to be targeted by the dsRNA regions in the RNA construct. Here, conservation is assessed at the level of the nucleic acid sequence. Such variable regions thus encompass the least conserved sections, at the level of the nucleic acid sequence, of the conserved target gene(s).
i) "conserved pathway" genes encompass genes that are involved in the same biological pathway or cellular process, or encompass genes that have the same functionality in different insect species resulting in a specific and potent RNAi effect and more efficient insect control;
j) alternatively, the RNA constructs according to the present invention target multiple genes from different biological pathways, resulting in a broad cellular RNAi effect and more efficient insect control.

According to the invention, all double stranded RNA regions comprise at least one strand that is complementary to at least part or a portion of the nucleotide sequence of any of the target genes herein described. However, provided one of the double stranded RNA regions comprises at least one strand that is complementary to a portion of the nucleotide sequence of any one of the target genes herein described, the other double stranded RNA regions may comprise at least one strand that is complementary to a portion of any other insect target gene (including known target genes).

According to yet another embodiment of the present invention there is provided an isolated double stranded RNA or RNA construct as herein described, further comprising at least one additional sequence and optionally a linker. In one embodiment, the additional sequence is chosen from the group comprising (i) a sequence facilitating large-scale production of the dsRNA construct; (ii) a sequence effecting an increase or decrease in the stability of the dsRNA; (iii) a sequence allowing the binding of proteins or other molecules to facilitate uptake of the RNA construct by insects; (iv) a sequence which is an aptamer that binds to a receptor or to a molecule on the surface or in the cytoplasm of an insect to facilitate uptake, endocytosis and/or transcytosis by the insect; or (v) additional sequences to catalyze processing of dsRNA regions. In one embodiment, the linker is a conditionally self-cleaving RNA sequence, preferably a pH sensitive linker or a hydrophobic sensitive linker. In one embodiment, the linker is an intron.

In one embodiment, the multiple dsRNA regions of the double-stranded RNA construct are connected by one or more linkers. In another embodiment, the linker is present at a site in the RNA construct, separating the dsRNA regions from another region of interest. Different linker types for the dsRNA constructs are provided by the present invention.

In another embodiment, the multiple dsRNA regions of the double-stranded RNA construct are connected without linkers.

In a particular embodiment of the invention, the linkers may be used to disconnect smaller dsRNA regions in the pest organism. Advantageously, in this situation the linker sequence may promote division of a long dsRNA into smaller dsRNA regions under particular circumstances, resulting in the release of separate dsRNA regions under these circumstances and leading to more efficient gene silencing by these smaller dsRNA regions. Examples of suitable conditionally self-cleaving linkers are RNA sequences that are self-cleaving at high pH conditions. Suitable examples of such RNA sequences are described by Borda et al. (Nucleic Acids Res. 2003 May 15; 31(10):2595-600), which document is incorporated herein by reference. This sequence originates from the catalytic core of the hammerhead ribozyme HH16.

In another aspect of the invention, a linker is located at a site in the RNA construct, separating the dsRNA regions from another, e.g. the additional, sequence of interest, which preferably provides some additional function to the RNA construct.

In one particular embodiment of the invention, the dsRNA constructs of the present invention are provided with an aptamer to facilitate uptake of the dsRNA by the insect. The aptamer is designed to bind a substance which is taken up by the insect. Such substances may be from an insect or plant origin. One specific example of an aptamer, is an aptamer that binds to a transmembrane protein, for example a transmembrane protein of an insect. Alternatively, the aptamer may bind a (plant) metabolite or nutrient which is taken up by the insect.

Alternatively, the linkers are self-cleaving in the endosomes. This may be advantageous when the constructs of the present invention are taken up by the insect via endocytosis or transcytosis, and are therefore compartmentalized in the endosomes of the insect species. The endosomes may have a low pH environment, leading to cleavage of the linker.

The above mentioned linkers that are self-cleaving in hydrophobic conditions are particularly useful in dsRNA constructs of the present invention when used to be transferred from one cell to another via the transit in a cell wall, for example when crossing the cell wall of an insect pest organism.

An intron may also be used as a linker. An "intron" as used herein may be any non-coding RNA sequence of a messenger RNA. Particular suitable intron sequences for the constructs of the present invention are (1) U-rich (35-45%); (2) have an average length of 100 bp (varying between about 50 and about 500 bp) which base pairs may be randomly chosen or may be based on known intron sequences; (3) start at the 5' end with -AG:GT- or -CG:GT- and/or (4) have at their 3' end -AG:GC- or -AG:AA-.

A non-complementary RNA sequence, ranging from about 1 base pair to about 10,000 base pairs, may also be used as a linker.

Without wishing to be bound by any particular theory or mechanism, it is thought that long double-stranded RNAs are taken up by the insect from their immediate environment. Double-stranded RNAs taken up into the gut and transferred to the gut epithelial cells are then processed within the cell into short double-stranded RNAs, called small interfering RNAs (siRNAs), by the action of an endogenous endonuclease. The resulting siRNAs then mediate RNAi via formation of a multi-component RNase complex termed the RISC or RNA interfering silencing complex.

In order to achieve down-regulation of a target gene within an insect cell the double-stranded RNA added to the exterior of the cell wall may be any dsRNA or dsRNA construct that can be taken up into the cell and then processed within the cell into siRNAs, which then mediate RNAi, or the RNA added to the exterior of the cell could itself be an siRNA that can be taken up into the cell and thereby direct RNAi.

siRNAs are generally short double-stranded RNAs having a length in the range of from 19 to 25 base pairs, or from 20 to 24 base pairs. In preferred embodiments siRNAs having 19, 20, 21, 22, 23, 24 or 25 base pairs, and in particular 21 or 22 base pairs, corresponding to the target gene to be down-regulated may be used. However, the invention is not intended to be limited to the use of such siRNAs.

siRNAs may include single-stranded overhangs at one or both ends, flanking the double-stranded portion. In a particularly preferred embodiment the siRNA may contain 3' overhanging nucleotides, preferably two 3' overhanging thymidines (dTdT) or uridines (UU). 3' TT or UU overhangs may be included in the siRNA if the sequence of the target gene immediately upstream of the sequence included in double-stranded part of the dsRNA is AA. This allows the TT or UU overhang in the siRNA to hybridise to the target gene. Although a 3' TT or UU overhang may also be included at the other end of the siRNA it is not essential for the target sequence downstream of the sequence included in double-stranded part of the siRNA to have AA. In this context, siRNAs which are RNA/DNA chimeras are also contemplated. These chimeras include, for example, the siRNAs comprising a double-stranded RNA with 3' overhangs of DNA bases (e.g. dTdT), as discussed above, and also double-stranded RNAs which are polynucleotides in which one or more of the RNA bases or ribonucleotides, or even all of the ribonucleotides on an entire strand, are replaced with DNA bases or deoxynucleotides.

The dsRNA may be formed from two separate (sense and antisense) RNA strands that are annealed together by (non-covalent) basepairing. Alternatively, the dsRNA may have a foldback stem-loop or hairpin structure, wherein the two annealed strands of the dsRNA are covalently linked. In this embodiment the sense and antisense stands of the dsRNA are formed from different regions of single polynucleotide molecule that is partially self-complementary. RNAs having this structure are convenient if the dsRNA is to be synthesised by expression in vivo, for example in a host cell or organism as discussed below, or by in vitro transcription. The precise nature and sequence of the "loop" linking the two RNA strands is generally not material to the invention, except that it should not impair the ability of the double-stranded part of the molecule to mediate RNAi. The features of "hairpin" or "stem-loop" RNAs for use in RNAi are generally known in the art (see for example WO 99/53050, in the name of CSIRO, the contents of which are incorporated herein by reference). In other embodiments of the invention, the loop structure may comprise linker sequences or additional sequences as described above.

The double-stranded RNA or construct may be prepared in a manner known per se. For example, double-stranded RNAs may be synthesised in vitro using chemical or enzymatic RNA synthesis techniques well known in the art. In one approach the two separate RNA strands may be synthesised separately and then annealed to form double-strands. In a further embodiment, double-stranded RNAs or constructs may be synthesised by intracellular expression in a host cell or organism from a suitable expression vector. This approach is discussed in further detail below.

The amount of double-stranded RNA with which the insect is contacted is such that specific down-regulation of the one or more target genes is achieved. The RNA may be introduced in an amount which allows delivery of at least one copy per cell. However, in certain embodiments higher doses (e.g., at least 5, 10, 100, 500 or 1000 copies per cell) of double-stranded RNA may yield more effective inhibition. For any given insect gene target the optimum amount of dsRNA for effective inhibition may be determined by routine experimentation.

The insect can be contacted with the double-stranded RNA in any suitable manner, permitting direct uptake of the double-stranded RNA by the insect. For example, the insect can be contacted with the double-stranded RNA in pure or substantially pure form, for example an aqueous solution containing the dsRNA. In this embodiment, the insect may be simply "soaked" with an aqueous solution comprising the double-stranded RNA. In a further embodiment the insect can be contacted with the double-stranded RNA by spraying the insect with a liquid composition comprising the double-stranded RNA.

Alternatively, the double-stranded RNA may be linked to a food component of the insects, such as a food component for a mammalian pathogenic insect, in order to increase uptake of the dsRNA by the insect.

The double-stranded RNA may also be incorporated in the medium in which the insect grows or in or on a material or substrate that is infested by the insect or impregnated in a substrate or material susceptible to infestation by insect.

According to another embodiment, the dsRNA is expressed in a bacterial or fungal cell and the bacterial or fungal cell is taken up or eaten by the insect species.

As illustrated in the examples, bacteria can be engineered to produce any of the dsRNA or dsRNA constructs of the invention. These bacteria can be eaten by the insect species. When taken up, the dsRNA can initiate an RNAi response, leading to the degradation of the target mRNA and weakening or killing of the feeding insect.

Therefore, in a more specific embodiment, said double-stranded RNA or RNA construct is expressed by a prokaryotic, such as a bacterial, or eukaryotic, such as a yeast, host cell or host organism. According to this embodiment, any bacterium or yeast cell that is capable of expressing dsRNA or dsRNA constructs can be used. The bacterium is chosen from the group comprising Gram-negative and Gram-positive bacteria, such as, but not limited to, *Escherichia* spp. (e.g. *E. coli*), *Bacillus* spp. (e.g. *B. thuringiensis*), *Rhizobium* spp., *Lactobacilllus* spp., *Lactococcus* spp., etc. The yeast may be chosen from the group comprising *Saccharomyces* spp., etc.

Some bacteria have a very close interaction with the host plant, such as, but not limited to, symbiotic *Rhizobium* with the Legminosea (for example Soy). Such recombinant bacteria could be mixed with the seeds (for instance as a coating) and used as soil improvers.

Accordingly, the present invention also encompasses a cell comprising any of the nucleotide sequences or recombinant DNA constructs described herein. The invention further encompasses prokaryotic cells (such as, but not limited to, gram-positive and gram-negative bacterial cells) and eukaryotic cells (such as, but not limited to, yeast cells or plant cells). Preferably said cell is a bacterial cell or a yeast cell or an algal cell.

In other embodiments the insect may be contacted with a composition as described further herein. The composition may, in addition to the dsRNA or DNA, contain further excipients, diluents or carriers. Preferred features of such compositions are discussed in more detail below.

Alternatively, dsRNA producing bacteria or yeast cells can be sprayed directly onto the crops.

Thus, as described above, the invention provides a host cell comprising an RNA construct and/or a DNA construct and/or an expression construct of the invention. Preferably, the host cell is a bacterial or yeast cell, but may be a virus for example. A virus such as a baculovirus may be utilised which specifically infects insects. This ensures safety for mammals, especially humans, since the virus will not infect the mammal, so no unwanted RNAi effect will occur.

The bacterial cell or yeast cell preferably should be inactivated before being utilised as a biological pesticide, for instance when the agent is to be used in an environment where contact with humans or other mammals is likely (such as a kitchen). Inactivation may be achieved by any means, such as by heat treatment, phenol or formaldehyde treatment for example, or by mechanical treatment.

In a still alternative embodiment, an inactivated virus, such as a suitably modified baculovirus may be utilised in order to deliver the dsRNA regions of the invention for mediating RNAi to the insect pest.

Possible applications include intensive greenhouse cultures, for instance crops that are less interesting from a GMO point of view, as well as broader field crops such as soy.

This approach has several advantages, eg: since the problem of possible dicing by a plant host is not present, it allows the delivery of large dsRNA fragments into the gut lumen of the feeding pest; the use of bacteria as insecticides does not involve the generation of transgenic crops, especially for certain crops where transgenic variants are difficult to obtain; there is a broad and flexible application in that different crops can be simultaneously treated on the same field and/or different pests can be simultaneously targeted, for instance by combining different bacteria producing distinct dsRNAs.

Another aspect of the present invention are target nucleotide sequences of the insect target genes herein disclosed. Such target nucleotide sequences are particularly important to design the dsRNA constructs according to the present invention. Such target nucleotide sequences are preferably at least 17, preferably at least 18, 19, 20 or 21, more preferably at least 22, 23 or 24 nucleotides in length. Non-limiting examples of preferred target nucleotide sequences are given in the examples.

According to one embodiment, the present invention provides an isolated nucleotide sequence encoding a double stranded RNA or double stranded RNA construct as described herein.

According to a more specific embodiment, the present invention relates to an isolated nucleic acid sequence consisting of a sequence represented by any of SEQ ID NOs 49 to 158, 275 to 472, 533 to 575, 621 to 767, 813 to 862, 908 to 1040, 1161 to 1571, 1730 to 2039, 2120 to 2338, 2384 to 2460, 2487, 2488, 2489, or a fragment of at least 17 preferably at least 18, 19, 20 or 21, more preferably at least 22, 23 or 24 nucleotides thereof.

A person skilled in the art will recognize that homologues of these target genes can be found and that these homologues are also useful in the methods of the present invention.

Protein, or nucleotide sequences are likely to be homologous if they show a "significant" level of sequence similarity or more preferably sequence identity. Truly homologous sequences are related by divergence from a common ancestor gene. Sequence homologues can be of two types: (i) where homologues exist in different species they are known as orthologues. e.g. the α-globin genes in mouse and human are orthologues. (ii) paralogues are homologous genes in within a single species. e.g. the α- and β-globin genes in mouse are paralogues Preferred homologues are genes comprising a sequence which is at least about 85% or 87.5%, still more preferably about 90%, still more preferably at least about 95% and most preferably at least about 99% identical to a sequence selected from the group of sequences represented by SEQ ID NOs 1, 3, 5, 7, 9, 11, 13, 15, 17, 19, 21, 23, 49 to 158, 159, 160-163, 168, 173, 178, 183, 188, 193, 198, 203, 208, 215, 220, 225, 230, 247, 249, 251, 253, 255, 257, 259, 275 to 472, 473, 478, 483, 488, 493, 498, 503, 513, 515, 517, 519, 521, 533 to 575, 576, 581, 586, 591, 596, 601, 603, 605, 607, 609, 621 to 767, 768, 773, 778, 783, 788, 793, 795, 797, 799, 801, 813 to 862, 863, 868, 873, 878, 883, 888, 890, 892, 894, 896, 908 to 1040, 1041, 1046, 1051, 1056, 1061, 1071, 1073, 1075, 1077, 1079, 1081, 1083, 1085, 1087, 1089, 1091, 1093, 1095, 1097, 1099, 1101, 1103, 1105, 1107, 1109, 1111, 1113, 1161 to 1571, 1572, 1577, 1582, 1587, 1592, 1597, 1602, 1607, 1612, 1617, 1622, 1627, 1632, 1637, 1642, 1647, 1652, 1657, 1662, 1667, 1672, 1677, 1682, 1684, 1686, 1688, 1690, 1692, 1694, 1696, 1698, 1700, 1702, 1704, 1730 to 2039, 2040, 2045, 2050, 2055, 2060, 2065, 2070, 2075, 2080, 2085, 2090, 2095, 2100, 2102, 2104, 2106, 2108, 2120 to 2338, 2339, 2344, 2349, 2354, 2359, 2364, 2366, 2368, 2370, 2372, 2384 to 2460, 2461, 2466, 2471, 2476, 2481, 2487, 2488, 2493 or 2495, or the complement thereof. Methods for determining sequence identity are routine in the art and include use of the Blast software and *EMBOSS software* (*The European Molecular Biology Open Software Suite* (2000), Rice, P. Longden, I. and Bleasby, A. Trends in Genetics 16, (6) pp 276-277). The term "identity" as used herein refers to the relationship between sequences at the nucleotide level. The expression "% identical" is determined by comparing optimally aligned sequences, e.g. two or more, over a comparison window wherein the portion of the sequence in the comparison window may comprise insertions or deletions as compared to the reference sequence for optimal alignment of the sequences. The reference sequence does not comprise insertions or deletions. The reference window is chosen from between at least 10 contiguous nucleotides to about 50, about 100 or to about 150 nucleotides, preferably between about 50 and 150 nucleotides. "% identity" is then calculated by determining the number of nucleotides that are identical between the sequences in the window, dividing the number of identical nucleotides by the number of nucleotides in the window and multiplying by 100.

Other homologues are genes which are alleles of a gene comprising a sequence as represented by any of SEQ ID NOs 1, 3, 5, 7, 9, 11, 13, 15, 17, 19, 21, 23, 49 to 158, 159, 160-163, 168, 173, 178, 183, 188, 193, 198, 203, 208, 215, 220, 225, 230, 247, 249, 251, 253, 255, 257, 259, 275 to 472, 473, 478, 483, 488, 493, 498, 503, 513, 515, 517, 519, 521, 533 to 575, 576, 581, 586, 591, 596, 601, 603, 605, 607, 609, 621 to 767, 768, 773, 778, 783, 788, 793, 795, 797, 799, 801, 813 to 862, 863, 868, 873, 878, 883, 888, 890, 892, 894, 896, 908 to 1040, 1041, 1046, 1051, 1056, 1061, 1071, 1073, 1075, 1077, 1079, 1081, 1083, 1085, 1087, 1089, 1091, 1093, 1095, 1097, 1099, 1101, 1103, 1105, 1107, 1109, 1111, 1113, 1161 to 1571, 1572, 1577, 1582, 1587, 1592, 1597, 1602, 1607, 1612, 1617, 1622, 1627, 1632, 1637, 1642, 1647, 1652, 1657, 1662, 1667, 1672, 1677, 1682, 1684, 1686, 1688, 1690, 1692, 1694, 1696, 1698, 1700, 1702, 1704, 1730 to 2039, 2040, 2045, 2050, 2055, 2060, 2065, 2070, 2075, 2080, 2085, 2090, 2095, 2100, 2102, 2104, 2106, 2108, 2120 to 2338, 2339, 2344, 2349, 2354, 2359, 2364, 2366, 2368, 2370, 2372, 2384 to 2460, 2461, 2466, 2471, 2476, 2481, 2487, 2488, 2493 or 2495. Further preferred homologues are genes comprising at least one single nucleotide polymorphism (SNIP) compared to a gene comprising a sequence as represented by any of SEQ ID NO 1, 3, 5, 7, 9, 11, 13, 15, 17, 19, 21, 23, 49 to 158, 159, 160-163, 168, 173, 178, 183, 188, 193, 198, 203, 208, 215, 220, 225, 230, 247, 249, 251, 253, 255, 257, 259, 275 to 472, 473, 478, 483, 488, 493, 498, 503, 513, 515, 517, 519, 521, 533 to 575, 576, 581, 586, 591, 596, 601, 603, 605, 607, 609, 621 to 767, 768, 773, 778, 783, 788, 793, 795, 797, 799, 801, 813 to 862, 863, 868, 873, 878, 883, 888, 890, 892, 894, 896, 908 to 1040, 1041, 1046, 1051, 1056, 1061, 1071, 1073, 1075, 1077, 1079, 1081, 1083, 1085, 1087, 1089, 1091, 1093, 1095, 1097, 1099, 1101, 1103, 1105, 1107, 1109, 1111, 1113, 1161 to 1571, 1572, 1577, 1582, 1587, 1592, 1597, 1602, 1607, 1612, 1617, 1622, 1627, 1632, 1637, 1642, 1647, 1652, 1657, 1662, 1667, 1672, 1677, 1682, 1684, 1686, 1688, 1690, 1692, 1694, 1696, 1698, 1700, 1702, 1704, 1730 to 2039, 2040, 2045, 2050, 2055, 2060, 2065, 2070, 2075, 2080, 2085, 2090, 2095, 2100, 2102, 2104, 2106, 2108, 2120 to 2338, 2339, 2344, 2349, 2354, 2359, 2364, 2366, 2368, 2370, 2372, 2384 to 2460, 2461, 2466, 2471, 2476, 2481, 2487, 2488, 2493 or 2495.

According to another embodiment, the invention encompasses target genes which are insect orthologues of a gene comprising a nucleotide sequence as represented in any of SEQ ID NOs 1, 3, 5, 7, 9, 11, 13, 15, 17, 19, 21, 23, 49 to 158, 159, 160-163, 168, 173, 178, 183, 188, 193, 198, 203, 208, 215, 220, 225, 230, 247, 249, 251, 253, 255, 257, 259, 275 to 472, 473, 478, 483, 488, 493, 498, 503, 513, 515, 517, 519, 521, 533 to 575, 576, 581, 586, 591, 596, 601, 603, 605, 607, 609, 621 to 767, 768, 773, 778, 783, 788, 793, 795, 797, 799, 801, 813 to 862, 863, 868, 873, 878, 883, 888, 890, 892, 894, 896, 908 to 1040, 1041, 1046, 1051, 1056, 1061, 1071, 1073, 1075, 1077, 1079, 1081, 1083, 1085, 1087, 1089, 1091, 1093, 1095, 1097, 1099, 1101, 1103, 1105, 1107, 1109, 1111, 1113, 1161 to 1571, 1572, 1577, 1582, 1587, 1592, 1597, 1602, 1607, 1612, 1617, 1622, 1627, 1632, 1637, 1642, 1647, 1652, 1657, 1662, 1667, 1672, 1677, 1682, 1684, 1686, 1688, 1690, 1692, 1694, 1696, 1698, 1700, 1702, 1704, 1730 to 2039, 2040, 2045, 2050, 2055, 2060, 2065, 2070, 2075, 2080, 2085, 2090, 2095, 2100, 2102, 2104, 2106, 2108, 2120 to 2338, 2339, 2344, 2349, 2354, 2359, 2364, 2366, 2368, 2370, 2372, 2384 to 2460, 2461, 2466, 2471, 2476, 2481, 2487, 2488, 2493 or 2495. By way of example, orthologues may comprise a nucleotide sequence as represented in any of SEQ ID NOs 49 to 123, 275 to 434, 533 to 562, 621 to 738, 813 to 852, 908 to 1010, 1161 to 1437, 1730 to 1987, 2120 to 2290, and 2384 to 2438, or a fragment thereof of at least 17, 18, 19, 20, 21, 22, 23, 24, 25, 26 or 27 nucleotides. A non-limiting list of insect or arachnida orthologues genes or sequences comprising at least a fragment of 17 bp of one of the sequences of the invention, is given in Tables 4.

According to another embodiment, the invention encompasses target genes which are nematode orthologues of a gene comprising a nucleotide sequence as represented in any of 1, 3, 5, 7, 9, 11, 13, 15, 17, 19, 21, 23, 49 to 158, 159, 160-163, 168, 173, 178, 183, 188, 193, 198, 203, 208, 215, 220, 225, 230, 247, 249, 251, 253, 255, 257, 259, 275 to 472, 473, 478, 483, 488, 493, 498, 503, 513, 515, 517, 519, 521, 533 to 575, 576, 581, 586, 591, 596, 601, 603, 605, 607, 609, 621 to 767, 768, 773, 778, 783, 788, 793, 795, 797, 799, 801, 813 to 862, 863, 868, 873, 878, 883, 888, 890, 892, 894, 896, 908 to 1040, 1041, 1046, 1051, 1056, 1061, 1071, 1073, 1075, 1077, 1079, 1081, 1083, 1085, 1087, 1089, 1091, 1093, 1095, 1097, 1099, 1101, 1103, 1105, 1107, 1109, 1111, 1113, 1161 to 1571, 1572, 1577, 1582, 1587, 1592, 1597, 1602, 1607, 1612, 1617, 1622, 1627, 1632, 1637, 1642, 1647, 1652, 1657, 1662, 1667, 1672, 1677, 1682, 1684, 1686, 1688, 1690, 1692, 1694, 1696, 1698, 1700, 1702, 1704, 1730 to 2039, 2040, 2045, 2050, 2055, 2060, 2065, 2070, 2075, 2080, 2085, 2090, 2095, 2100, 2102, 2104, 2106, 2108, 2120 to 2338, 2339, 2344, 2349, 2354, 2359, 2364, 2366, 2368, 2370, 2372, 2384 to 2460, 2461, 2466, 2471, 2476, 2481, 2487, 2488, 2493 or 2495. By way of example, nematode orthologues may comprise a nucleotide sequence as represented in any of SEQ ID NOs 124 to 135, 435 to 446, 563 to 564, 739 to 751, 853, 854, 1011 to 1025, 1438 to 1473, 1988 to 2001, 2291 to 2298, 2439 or 2440, or a fragment of at least 17, 18, 19, 20 or 21 nucleotides thereof. According to another aspect, the invention thus encompasses any of the methods described herein for controlling nematode growth in an organism, or for preventing nematode infestation of an organism susceptible to nematode infection, comprising contacting nematode cells with a double-stranded RNA, wherein the double-stranded RNA comprises annealed complementary strands, one of which has a nucleotide sequence which is complementary to at least part of the nucleotide sequence of a target gene comprising a fragment of at least 17, 18, 19, 20 or 21 nucleotides of any of the sequences as represented in SEQ ID NOs 124 to 135, 435 to 446, 563 to 564, 739 to 751, 853, 854, 1011 to 1025, 1438 to 1473, 1988 to 2001, 2291 to 2298, 2439 or 2440, whereby the double-stranded RNA is taken up by the nematode and thereby controls growth or prevents infestation.

According to another embodiment, the invention encompasses target genes which are fungal orthologues of a gene comprising a nucleotide sequence as represented in any of 1, 3, 5, 7, 9, 11, 13, 15, 17, 19, 21, 23, 49 to 158, 159, 160-163, 168, 173, 178, 183, 188, 193, 198, 203, 208, 215, 220, 225, 230, 247, 249, 251, 253, 255, 257, 259, 275 to 472, 473, 478, 483, 488, 493, 498, 503, 513, 515, 517, 519, 521, 533 to 575, 576, 581, 586, 591, 596, 601, 603, 605, 607, 609, 621 to 767, 768, 773, 778, 783, 788, 793, 795, 797, 799, 801, 813 to 862, 863, 868, 873, 878, 883, 888, 890, 892, 894, 896, 908 to 1040, 1041, 1046, 1051, 1056, 1061, 1071, 1073, 1075, 1077, 1079, 1081, 1083, 1085, 1087, 1089, 1091, 1093, 1095, 1097, 1099, 1101, 1103, 1105, 1107, 1109, 1111, 1113, 1161 to 1571, 1572, 1577, 1582, 1587, 1592, 1597, 1602, 1607, 1612, 1617, 1622, 1627, 1632, 1637, 1642, 1647, 1652, 1657, 1662, 1667, 1672, 1677, 1682, 1684, 1686, 1688, 1690, 1692, 1694, 1696, 1698, 1700, 1702, 1704, 1730 to 2039, 2040, 2045, 2050, 2055, 2060, 2065, 2070, 2075, 2080, 2085, 2090, 2095, 2100, 2102, 2104, 2106, 2108, 2120 to 2338, 2339, 2344, 2349, 2354, 2359, 2364, 2366, 2368, 2370, 2372, 2384 to 2460, 2461, 2466, 2471, 2476, 2481, 2487, 2488, 2493 or 2495. By way of example, fungal orthologues may comprise a nucleotide sequence as represented in any of SEQ ID NOs 136 to 158, 447 to 472, 565 to 575, 752 to 767, 855 to 862, 1026 to 1040, 1475 to 1571, 2002 to 2039, 2299 to 2338, 2441 to 2460, or a fragment of at least 17, 18, 19, 20, 21, 22, 23, 24, 25, 26 or 27 nucleotides thereof. According to another aspect, the invention thus encompasses any of the methods described herein for controlling fungal growth on a cell or an organism, or for preventing fungal infestation of a cell or an organism susceptible to fungal infection, comprising contacting fungal cells with a double-stranded RNA, wherein the double-stranded RNA comprises annealed complementary strands, one of which has a nucleotide sequence which is complementary to at least part of the nucleotide sequence of a target gene comprising a fragment of at least 17, 18, 19, 20 or 21 nucleotides of any of the sequences as represented in SEQ ID NOs 136 to 158, 447 to 472, 565 to 575, 752 to 767, 855 to 862, 1026 to 1040, 1475 to 1571, 2002 to 2039, 2299 to 2338, 2441 to 2460, whereby the double-stranded RNA is taken up by the fungus and thereby controls growth or prevents infestation. A non-limiting list of fungal orthologues genes or sequences comprising at least a fragment of 17 bp of one of the sequences of the invention, is given in Tables 6.

The term "regulatory sequence" is to be taken in a broad context and refers to a regulatory nucleic acid capable of effecting expression of the sequences to which it is operably linked.

Encompassed by the aforementioned term are promoters and nucleic acids or synthetic fusion molecules or derivatives thereof which activate or enhance expression of a nucleic acid, so called activators or enhancers. The term "operably linked" as used herein refers to a functional linkage between the "promoter" sequence and the nucleic acid molecule of interest, such that the "promoter" sequence is able to initiate transcription of the nucleic acid molecule to produce the appropriate dsRNA.

A preferred regulatory sequence is a promoter, which may be a constitutive or an inducible promoter. Preferred promoters are inducible promoters to allow tight control of expression of the RNA molecules. Promoters inducible through use of an appropriate chemical, such as IPTG are preferred. Alternatively, the transgene encoding the RNA molecule is placed under the control of a strong constitutive promoter. Preferably, any promoter which is used will direct strong expression of the RNA. The nature of the promoter utilised may, in part, be determined by the specific host cell utilised to produce the RNA. In one embodiment, the regulatory sequence comprises a bacteriophage promoter, such as a T7, T3, SV40 or SP6 promoter, most preferably a T7 promoter. In yet other embodiments of the present invention, other promoters useful for the expression of RNA are used and include, but are not limited to, promoters from an RNA Pol I, an RNA Pol II or an RNA Pol III polymerase. Other promoters derived from yeast or viral genes may also be utilised as appropriate.

In an alternative embodiment, the regulatory sequence comprises a promoter selected from the well known tac, trc and lac promoters. Inducible promoters suitable for use with bacterial hosts include β-lactamase promoter, *E. coli* λ phage PL and PR promoters, and *E. coli* galactose promoter, arabinose promoter and alkaline phosphatase promoter. Therefore, the present invention also encompasses a method for generating any of the RNA molecules or RNA constructs of the invention. This method comprises the steps of introducing (e.g. by transformation, transfection or injection) an isolated nucleic acid or a recombinant (DNA) construct of the invention in a host cell of the invention under conditions that allow transcription of said nucleic acid or recombinant (DNA) construct to produce the RNA which acts to down regulate a target gene of interest (when the host cell is ingested by the target organism or when a host cell or extract derived therefrom is taken up by the target organism).

Optionally, one or more transcription termination sequences or "terminators" may also be incorporated in the recombinant construct of the invention. The term "transcription termination sequence" encompasses a control sequence at the end of a transcriptional unit, which signals 3' processing and poly-adenylation of a primary transcript and termination of transcription. The transcription termination sequence is useful to prevent read through transcription such that the RNA molecule is accurately produced in or by the host cell. In one embodiment, the terminator comprises a T7, T3, SV40 or SP6 terminator, preferably a T7 terminator. Other terminators derived from yeast or viral genes may also be utilised as appropriate.

Additional regulatory elements, such as transcriptional or translational enhancers, may be incorporated in the expression construct.

The recombinant constructs of the invention may further include an origin of replication which is required for maintenance and/or replication in a specific cell type. One example is when an expression construct is required to be maintained in a bacterial cell as an episomal genetic element (e.g. plasmid or cosmid molecule) in a cell. Preferred origins of replication include, but are not limited to, f1-ori and colE1 ori.

The recombinant construct may optionally comprise a selectable marker gene. As used herein, the term "selectable marker gene" includes any gene, which confers a phenotype on a cell in which it is expressed to facilitate the identification and/or selection of cells, which are transfected or transformed, with a recombinant (expression) construct of the invention. Examples of suitable selectable markers include resistance genes against ampicillin (Ampr), tetracycline (Tcr), kanamycin (Kanr), phosphinothricin, and chloramphenicol (CAT) gene. Other suitable marker genes provide a metabolic trait, for example manA. Visual marker genes may also be used and include for example beta-glucuronidase (GUS), luciferase and green fluorescent protein (GFP).

In yet other embodiments of the present invention, other promoters useful for the expression of dsRNA are used and include, but are not limited to, promoters from an RNA PolI, an RNA PolII, an RNA PolIII, T7 RNA polymerase or SP6 RNA polymerase. These promoters are typically used for in vitro-production of dsRNA, which dsRNA is then included in an antiinsecticidal agent, for example, in an anti-insecticidal liquid, spray or powder.

Therefore, the present invention also encompasses a method for generating any of the double-stranded RNA or RNA constructs of the invention. This method comprises the steps of
 a. contacting an isolated nucleic acid or a recombinant DNA construct of the invention with cell-free components; or
 b. introducing (e.g. by transformation, transfection or injection) an isolated nucleic acid or a recombinant DNA construct of the invention in a cell,
under conditions that allow transcription of said nucleic acid or recombinant DNA construct to produce the dsRNA or RNA construct.

Optionally, one or more transcription termination sequences may also be incorporated in the recombinant construct of the invention. The term "transcription termination sequence" encompasses a control sequence at the end of a transcriptional unit, which signals 3' processing and poly-adenylation of a primary transcript and termination of transcription. Additional regulatory elements, such as transcriptional or translational enhancers, may be incorporated in the expression construct.

The recombinant constructs of the invention may further include an origin of replication which is required for maintenance and/or replication in a specific cell type. One example is when an expression construct is required to be maintained in a bacterial cell as an episomal genetic element (e.g. plasmid or cosmid molecule) in a cell. Preferred origins of replication include, but are not limited to, f1-ori and colE1 ori.

The recombinant construct may optionally comprise a selectable marker gene. As used herein, the term "selectable marker gene" includes any gene, which confers a phenotype on a cell in which it is expressed to facilitate the identification and/or selection of cells, which are transfected or transformed, with an expression construct of the invention. Examples of suitable selectable markers include resistance genes against ampicillin (Ampr), tetracycline (Tcr), kanamycin (Kanr), phosphinothricin, and chloramphenicol (CAT) gene. Other suitable marker genes provide a metabolic trait, for example manA. Visual marker genes may also be used and include for example beta-glucuronidase (GUS), luciferase and Green Fluorescent Protein (GFP).

The present invention relates to methods for preventing insect growth on a plant or for preventing insect infestation of a plant. The plants to be treated according to the methods of the invention encompasses plants selected from the group comprising: alfalfa, apple, apricot, artichoke, asparagus, avocado, banana, barley, beans, beet, blackberry, blueberry, broccoli, brussel sprouts, cabbage, canola, carrot, cassava, cauliflower, a cereal, celery, cherry, citrus, clementine, coffee, corn, cotton, cucumber, eggplant, endive, eucalyptus, figs, grape, grapefruit, groundnuts, ground cherry, kiwifruit, lettuce, leek, lemon, lime, pine, maize, mango, melon, millet, mushroom, nut aot, okra, onion, orange, an ornamental plant or flower or tree, papaya, parsley, pea, peach, peanut, peat, pepper, persimmon, pineapple, plantain, plum, pomegranate, potato, pumpkin, radicchio, radish, rapeseed, raspberry, rice, rye, sorghum, soy, soybean, spinach, strawberry, sugarbeet, sugarcane, sunflower, sweet potato, tangerine, tea, tobacco, tomato, a vine, watermelon, wheat, yams or zucchini plant; preferably a potato, eggplant, tomato, pepper, tobacco, ground cherry, rice corn or cotton plant), or a seed or tuber (e.g. an alfalfa, apple, apricot, artichoke, asparagus, avocado, banana, barley, beans, beet, blackberry, blueberry, broccoli, brussel sprouts, cabbage, canola, carrot, cassava, cauliflower, a cereal, celery, cherry, citrus, clementine, coffee, corn, cotton, cucumber, eggplant, endive, eucalyptus, figs, grape, grapefruit, groundnuts, ground cherry, kiwifruit, lettuce, leek, lemon, lime, pine, maize, mango, melon, millet, mushroom, nut aot, okra, onion, orange, an ornamental plant or flower or tree, papaya, parsley, pea, peach, peanut, peat, pepper, persimmon, pineapple, plantain, plum, pomegranate, potato, pumpkin, radicchio, radish, rapeseed, raspberry, rice, rye, sorghum, soy, soybean, spinach, strawberry, sugarbeet, sugarcane, sunflower, sweet potato, tangerine, tea, tobacco, tomato, a vine, watermelon, wheat, yams and zucchini.

The amount of targeted RNA which is taken up, preferably by ingestion, by the target organism is such that specific down-regulation of the one or more target genes is achieved. The RNA may be expressed by the host cell in an amount which allows delivery of at least one copy per cell. However, in certain embodiments higher doses (e.g., at least 5, 10, 100, 500 or 1000 copies per cell of the target organism) of RNA may yield more effective inhibition. For any given target gene and target organism the optimum amount of the targeted RNA molecules for effective inhibition may be determined by routine experimentation.

The target organism can be contacted with the host cell expressing the RNA molecule in any suitable manner, to permit ingestion by the target organism. Preferably, the host cells expressing the dsRNA may be linked to a food component of the target organisms in order to increase uptake of the dsRNA by the target organism. The host cells expressing the dsRNA may also be incorporated in the medium in which the target organism grows or in or on a material or substrate that is infested by a pest organism or impregnated in a substrate or material susceptible to infestation by a pest organism.

In alternative embodiments, a suitable extract derived from the host cells expressing the RNA molecule may be utilised in order to achieve down regulation of a target gene in a target organism. Here, the extracts may be derived by any suitable means of lysis of the host cells expressing the RNA molecules. For example, techniques such as sonication, French press, freeze-thaw and lysozyme treatment (see Sambrook and Russell—Molecular Cloning: A laboratory manual—third edition and the references provided therein in table 15-4) may be utilised in order to prepare a crude host cell extract (lysate). Further purification of the extract may be carried out as appropriate provided the ability of the extract to mediate targeted down regulation of target gene expression is not adversely affected. Affinity purification may be utilised for example. It may also be appropriate to add certain components to the extract, to prevent degradation of the RNA molecules. For example, RNase inhibitors may be added to the extracts derived from the host cells expressing the RNA. In one example, the target organism can be contacted with the host cell expressing the RNA in pure or substantially pure form, for example an aqueous solution containing the cell extract. In this embodiment, the target organism, especially pest organisms such as insects may be simply "soaked" with an aqueous solution comprising the host cell extract. In a further embodiment the target organism can be contacted with the host cells expressing the RNA molecule by spraying the target organism with a liquid composition comprising the cell extract.

If the method of the invention is used for specifically controlling growth or infestation of a specific pest, it is preferred that the RNA expressed in the host cell does not share any significant homology with a gene or genes from a non-pest organism, in particular that it does not share any significant homology with any essential gene of the non-pest organism. Thus, the non-pest organism is typically the organism susceptible to infestation by the pest and which is therefore protected from the pest according to the methods of the invention. So, for example, non-pest species may comprise a plant or a mammalian species. Preferably, the mammalian species is *Homo sapiens*. The non-target species may also include animals other than humans which may be exposed to the organism or substrate protected against infestation. Examples include birds which may feed on protected plants, and livestock and domestic animals such as cats, dogs, horses, cattle, chickens, pigs, sheep etc. In this context, it is preferred that the dsRNA shows less than 30%, more preferably less that 20%, more preferably less than 10%, and even more preferably less than 5% nucleic acid sequence identity with any gene of the susceptible or non-target organism. Percentage sequence identity should be calculated across the full length of the targeted RNA region. If genomic sequence data is available for the organism to be protected according to the invention or for any non-target organism, one may cross-check sequence identity with the targeted RNA using standard bioinformatics tools. In one embodiment, there is no sequence identity between the RNA molecule and a non-pest organism's genes over 21 contiguous nucleotides, meaning that in this context, it is preferred that 21 contiguous nucleotides of the RNA do not occur in the genome of the non-pest organism. In another embodiment, there is less than about 10% or less than about 12.5% sequence identity over 24 contiguous nucleotides of the RNA with any nucleotide sequence from a non-pest (susceptible) species. In particular, orthologous genes from a non-pest species may be of particular note, since essential genes from the pest organism may often be targeted in the methods of the invention. Thus, in one embodiment, the RNA molecule has less than 12.5% sequence identity with the corresponding nucleotide sequence of an orthologous gene from a non-pest species.

In a further embodiment, the invention relates to a composition for controlling insect growth and/or preventing or reducing insect infestation, comprising at least one double-stranded RNA, wherein said double-stranded RNA comprises annealed complementary strands, one of which has a nucleotide sequence which is complementary to at least part of a nucleotide sequence of an insect target gene. The invention also relates to a composition comprising at least one of the nucleotide sequence or at least one recombinant DNA construct as described herein. The invention also relates to a composition comprising at least one bacterial cell or yeast cell expressing at least one double stranded RNA or a double stranded RNA construct as described herein; or expressing at least one nucleotide sequence or a recombinant DNA construct as described herein. Optionally, the composition further comprises at least one suitable carrier, excipient or diluent. The target gene may be any target gene described herein. Preferably the insect target gene is essential for the viability, growth, development or reproduction of the insect.

In another aspect the invention relates to a composition as described above, wherein the insect target gene comprises a sequence which is at least 75%, preferably at least 80%, 85%, 90%, more preferably at least 95%, 98% or 99% identical to a sequence selected from the group of sequences represented by any of SEQ ID NOs 1, 3, 5, 7, 9, 11, 13, 15, 17, 19, 21, 23, 49 to 158, 159, 160-163, 168, 173, 178, 183, 188, 193, 198, 203, 208, 215, 220, 225, 230, 240 to 247, 249, 251, 253, 255, 257, 259, 275 to 472, 473, 478, 483, 488, 493, 498, 503, 508 to 513, 515, 517, 519, 521, 533 to 575, 576, 581, 586, 591, 596, 601, 603, 605, 607, 609, 621 to 767, 768, 773, 778, 783, 788, 793, 795, 797, 799, 801, 813 to 862, 863, 868, 873, 878, 883, 888, 890, 892, 894, 896, 908 to 1040, 1041, 1046, 1051, 1056, 1061, 1066 to 1071, 1073, 1075, 1077, 1079, 1081, 1083, 1085, 1087, 1089, 1091, 1093, 1095, 1097, 1099, 1101, 1103, 1105, 1107, 1109, 1111, 1113, 1161 to 1571, 1572, 1577, 1582, 1587, 1592, 1597, 1602, 1607, 1612, 1617, 1622, 1627, 1632, 1637, 1642, 1647, 1652, 1657, 1662, 1667, 1672, 1677, 1682, 1684, 1686, 1688, 1690, 1692, 1694, 1696, 1698, 1700, 1702, 1704, 1730 to 2039, 2040, 2045, 2050, 2055, 2060, 2065, 2070, 2075, 2080, 2085, 2090, 2095, 2100, 2102, 2104, 2106, 2108, 2120 to 2338, 2339, 2344, 2349, 2354, 2359, 2364, 2366, 2368, 2370, 2372, 2384 to 2460, 2461, 2466, 2471, 2476, 2481, 2486, 2487, 2488, 2493 or 2495, or the complement thereof, or wherein said insect target gene is an insect orthologue of a gene comprising at least 17 contiguous nucleotides of any of SEQ ID NOs 1, 3, 5, 7, 9, 11, 13, 15, 17, 19, 21, 23, 49 to 158, 159, 160-163, 168, 173, 178, 183, 188, 193, 198, 203, 208, 215, 220, 225, 230, 240 to 247, 249, 251, 253, 255, 257, 259, 275 to 472, 473, 478, 483, 488, 493, 498, 503, 508 to 513, 515, 517, 519, 521, 533 to 575, 576, 581, 586, 591, 596, 601, 603, 605, 607, 609, 621 to 767, 768, 773, 778, 783, 788, 793, 795, 797, 799, 801, 813 to 862, 863, 868, 873, 878, 883, 888, 890, 892, 894, 896, 908 to 1040, 1041, 1046, 1051, 1056, 1061, 1066 to 1071, 1073, 1075, 1077, 1079, 1081, 1083, 1085, 1087, 1089, 1091, 1093, 1095, 1097, 1099, 1101, 1103, 1105, 1107, 1109, 1111, 1113, 1161 to 1571, 1572, 1577, 1582, 1587, 1592, 1597, 1602, 1607, 1612, 1617, 1622, 1627, 1632, 1637, 1642, 1647, 1652, 1657, 1662, 1667, 1672, 1677, 1682, 1684, 1686, 1688, 1690, 1692, 1694, 1696, 1698, 1700, 1702, 1704, 1730 to 2039, 2040, 2045, 2050, 2055, 2060, 2065, 2070, 2075, 2080, 2085, 2090, 2095, 2100, 2102, 2104, 2106, 2108, 2120 to 2338, 2339, 2344, 2349, 2354, 2359, 2364, 2366, 2368, 2370, 2372, 2384 to 2460, 2461, 2466, 2471, 2476, 2481, 2486, 2487, 2488, 2493 or 2495, or the complement thereof.

The present invention further relates to a composition comprising at least one double-stranded RNA, at least one double-stranded RNA construct, at least one nucleotide sequence, at least one recombinant DNA construct and/or at least one host cell (e.g. a bacterial or a yeast) expressing a dsRNA of the invention, or a virus encoding a dsRNA of the invention, optionally further comprising at least one suitable carrier, excipient or diluent.

The composition may be in any suitable physical form for application to insects. The composition may be in solid form (such as a powder, pellet or a bait), liquid form (such as a spray) or gel form for example.

According to a most preferred embodiment, the composition is in a form suitable for ingestion by an insect.

The composition may contain further components which serve to stabilise the dsRNA and/or prevent degradation of the dsRNA during prolonged storage of the composition.

The composition may still further contain components which enhance or promote uptake of the dsRNA by the insect. These may include, for example, chemical agents which generally promote the uptake of RNA into cells e.g. lipofectamin etc.

The composition may still further contain components which serve to preserve the viability of the host cell during prolonged storage.

The composition may be in any suitable physical form for application to insects, to substrates, to cells (e.g. plant cells), or to organisms infected by or susceptible to infestation by insects.

In one embodiment, the composition may be provided in the form of a spray. Thus, a human user can spray the insect or the substrate directly with the composition.

The present invention thus relates to a spray comprising a composition comprising at least one bacterial cell or yeast cell expressing at least one double stranded RNA or a double stranded RNA construct as described herein; or expressing at least one nucleotide sequence or a recombinant DNA construct as described herein. More specific, the invention relates to a spray as defined above wherein said bacterial cell comprises at least one of the sequences represented by any of SEQ ID NOs 1, 3, 5, 7, 9, 11, 13, 15, 17, 19, 21, 23, 49 to 158, 159, 160-163, 168, 173, 178, 183, 188, 193, 198, 203, 208, 215, 220, 225, 230, 240 to 247, 249, 251, 253, 255, 257, 259, 275 to 472, 473, 478, 483, 488, 493, 498, 503, 508 to 513, 515, 517, 519, 521, 533 to 575, 576, 581, 586, 591, 596, 601, 603, 605, 607, 609, 621 to 767, 768, 773, 778, 783, 788, 793, 795, 797, 799, 801, 813 to 862, 863, 868, 873, 878, 883, 888, 890, 892, 894, 896, 908 to 1040, 1041, 1046, 1051, 1056, 1061, 1066 to 1071, 1073, 1075, 1077, 1079, 1081, 1083, 1085, 1087, 1089, 1091, 1093, 1095, 1097, 1099, 1101, 1103, 1105, 1107, 1109, 1111, 1113, 1161 to 1571, 1572, 1577, 1582, 1587, 1592, 1597, 1602, 1607, 1612, 1617, 1622, 1627, 1632, 1637, 1642, 1647, 1652, 1657, 1662, 1667, 1672, 1677, 1682, 1684, 1686, 1688, 1690, 1692, 1694, 1696, 1698, 1700, 1702, 1704, 1730 to 2039, 2040, 2045, 2050, 2055, 2060, 2065, 2070, 2075, 2080, 2085, 2090, 2095, 2100, 2102, 2104, 2106, 2108, 2120 to 2338, 2339, 2344, 2349, 2354, 2359, 2364, 2366, 2368, 2370, 2372, 2384 to 2460, 2461, 2466, 2471, 2476, 2481, 2486, 2487, 2488, 2489, 2493 or 2495, or a fragment thereof of at least 17 contiguous nucleotides.

The invention also relates to a spray comprising at least one composition or comprising at least one host cell as described herein, and further at least one adjuvant and optionally at least one surfactant The effectiveness of a pesticide may depend on the effectiveness of the spray application. Adjuvants can minimize or eliminate many spray application problems associated with pesticide stability, solubility, incompatibility, suspension, foaming, drift, evaporation, volatilization, degradation, adherence, penetration, surface tension, and coverage. Adjuvants are designed to perform specific functions, including wetting, spreading, sticking, reducing evaporation, reducing volatilization, buffering, emulsifying, dispersing, reducing spray drift, and reducing foaming. No single adjuvant can perform all these functions, but different compatible adjuvants often can be combined to perform multiple functions simultaneously. These chemicals, also called wetting agents and spreaders, physically alter the surface tension of a spray droplet. For a pesticide to perform its function properly, a spray droplet must be able to wet the foliage and spread out evenly over a leaf. Surfactants enlarge the area of pesticide coverage, thereby increasing the pest's exposure to the chemical. Surfactants are particularly important when applying a pesticide to waxy or hairy leaves. Without proper wetting and spreading, spray droplets often run off or fail to adequately cover these surfaces. Too much surfactant, however, can cause excessive runoff or deposit loss, thus reducing pesticide efficacy. Pesticide formulations often contain surfactants to improve the suspension of the pesticide's active ingredient. This is especially true for emulsifiable concentrate (EC) formulations.

As used herein the term "adjuvant" means any nonpesticide material added to a pesticide product or pesticide spray mixture to improve the mixing and stability of the products in the spray tank and the application. As further used herein the term "surfactant" means a chemical that modifies surface tension. Surfactants can influence the wetting and spreading of liquids, and can modify the dispersion, suspension, or precipitation of a pesticide in water. There are nonionic surfactants (no electrical charge), anionic surfactants (negative charge), and cationic surfactants (positive charge)

In particular embodiments the host cells comprised in the spray are inactivated, for instance by heat inactiviation or mechanical disruption (as discussed in greater detail herein).

The nature of the excipients and the physical form of the composition may vary depending upon the nature of the substrate that it is desired to treat. For example, the composition may be a liquid that is brushed or sprayed onto or imprinted into the material or substrate to be treated, or a coating or powder that is applied to the material or substrate to be treated. Thus, in one embodiment, the composition is in the form of a coating on a suitable surface which adheres to, and is eventually ingested by an insect which comes into contact with the coating.

According to a preferred embodiment, the substrate is a plant or crop to be treated against insect pest infestation. The composition is then internalized or eaten by the insect, from where it can mediate RNA interference, thus controlling the insect The spray is preferably a pressurized/aerosolized spray or a pump spray. The particles may be of suitable size such that they adhere to the substrate to be treated or to the insect, for example to the exoskeleton, of the insect and/or arachnid and may be absorbed therefrom.

In one embodiment, the composition is in the form of a bait. The bait is designed to lure the insect to come into contact with the composition. Upon coming into contact therewith, the composition is then internalised by the insect, by ingestion for example and mediates RNAi to thus kill the insect. Said bait may comprise a food substance, such as a protein based food, for example fish meal. Boric acid may also be used as a bait. The bait may depend on the species being targeted. An attractant may also be used. The attractant may be a pheromone, such as a male or female pheromone for example. As an example, the pheromones referred to in the book "Insect Pheromones and their use in Pest Management" (Howse et al, Chapman and Hall, 1998) may be used in the invention. The attractant acts to lure the insect to the bait, and may be targeted for a particular insect or may attract a whole range of insects. The bait may be in any suitable form, such as a solid, paste, pellet or powdered form.

The bait may also be carried away by the insect back to the colony. The bait may then act as a food source for other members of the colony, thus providing an effective control of a large number of insects and potentially an entire insect pest colony. This is an advantage associated with use of the double stranded RNA or bacteria expressing the dsRNA of the invention, because the delayed action of the RNAi mediated effects on the pests allows the bait to be carried back to the colony, thus delivering maximal impact in terms of exposure to the insects.

Additionally, compositions which come into contact with the insects may remain on the cuticle of the insect. When cleaning, either an individual insect cleaning itself or insects cleaning one another, the compositions may be ingested and can thus mediate their effects in the insect. This requires that the composition is sufficiently stable such that the dsRNA or host cells expressing dsRNA remain intact and capable of mediating RNAi even when exposed to external environmental conditions for a length of time, which may be a period of days for example.

The baits may be provided in a suitable "housing" or "trap". Such housings and traps are commercially available and existing traps may be adapted to include the compositions of the invention. Any housing or trap which may attract an insect to enter it is included within the scope of the invention. The housing or trap may be box-shaped for example, and may be provided in pre-formed condition or may be formed of foldable cardboard for example. Suitable materials for a housing or trap include plastics and cardboard, particularly corrugated cardboard. Suitable dimensions for such a housing or trap are, for example, 7-15 cm wide, 15-20 cm long and 1-5 cm high. The inside surfaces of the traps may be lined with a sticky substance in order to restrict movement of the insect once inside the trap. The housing or trap may contain a suitable trough inside which can hold the bait in place. A trap is distinguished from a housing because the insect can not readily leave a trap following entry, whereas a housing acts as a "feeding station" which provides the insect arachnid with a preferred environment in which they can feed and feel safe from predators.

Accordingly, in a further aspect the invention provides a housing or trap for insects which contains a composition of the invention, which may incorporate any of the features of the composition described herein.

It is contemplated that the "composition" of the invention may be supplied as a "kit-of-parts" comprising the double-stranded RNA in one container and a suitable diluent, excipient or carrier for the RNA containing entity (such as a ds RNA or ds RNA construct, DNA construct, expression construct) in a separate container; or comprising the host cell(s) in one container and a suitable diluent, excipient, carrier or preservative for the host cell in a separate container. The invention also relates to supply of the double-stranded RNA or host cells alone without any further components. In these embodiments the dsRNA or host cells may be supplied in a concentrated form, such as a concentrated aqueous solution. It may even be supplied in frozen form or in freeze-dried or lyophilised form. The latter may be more stable for long term storage and may be de-frosted and/or reconstituted with a suitable diluent immediately prior to use.

The present invention further encompasses a method for controlling growth of a pest organism and/or for preventing infestation of a susceptible organism by the pest organism on a substrate comprising applying an effective amount of any of the compositions and/or sprays as described herein to said substrate.

The invention further encompasses a method for treating and/or preventing a disease or condition caused by a target organism, comprising administering to a subject in need of such treatment and/or prevention, a composition or a spray as described herein, wherein down-regulation of expression of the target gene in the target organism caused by the composition or spray is effective to treat and/or prevent the disease caused by the target organism. A preferred target organism is a pest, in particular an insect as described in more detail herein.

The present invention further relates to the medical use of any of the double-stranded RNAs, double-stranded RNA constructs, nucleotide sequences, recombinant DNA constructs or compositions described herein.

Insects and other Arthropods can cause injury and even death by their bites or stings. More people die each year in the United States from bee and wasp stings than from snake bites. Many insects can transmit bacteria and other pathogens that cause diseases. During every major war between countries, more people have been injured or killed by diseases transmitted by insects than have been injured or killed by bullets and bombs. Insects that bite man and domestic animals are mostly those with piercing-sucking mouthparts, as found in Hemiptera and some Diptera. Much of the discomfort from a bite is a result of enzymes that the insect pumps into the victim. Ticks and chiggers are different kinds of mites (Class Arachnida) that feed on blood of animals. Ticks can also transmit viruses and other pathogens that cause diseases, including Lyme disease and Rocky Mountain spotted fever. Other kinds of mites can cause mange on humans, dogs, cats, and other animals. Order Hemiptera includes bed bugs, kissing bugs, and assassin bugs, all of which have beaks for piercing their hosts. The most painful bites among all insects are those of assassin bugs. Kissing bugs are involved in causing Chagas disease in Central and South America. The caterpillars of some moths can "sting." The Diptera are the most important order of insects that affect people. Biting flies include many species of mosquitoes, black flies, biting gnats, horse flies, and others. Many of these biting flies are transmitters of diseases, such as the tse-tse fly that transmits African sleeping sickness. Flies with sponging mouthparts, such as the house fly, also transmit bacteria and other pathogens that cause typhoid fever and other diseases. Screwworms and maggots of both flies are fly larvae that invade living tissue of animals. Mosquitoes transmit pathogens that cause malaria, yellow fever, encephalitis, and other diseases. Malaria is caused by a protozoan parasite that lives part of its life cycle in the *Anopheles* mosquitoes and part of its cycle in humans. Plague, also known as bubonic plague or black death, is caused by bacteria that infect rats and other rodents. The main transmitter of this disease to humans is the Oriental rat flea (Order Siphonaptera). Many bees, wasps, and ants (Order Hymenoptera) can cause pain and even death by their stinging. Deaths usually are a result of allergic reactions to the venom. Other major stingers include hornets, yellow jackets, and paper wasps. The Africanized honey bee, or "killer" bee is a strain of our domesticated honey bee. The two strains are almost identical in appearance. However, the Africanized strain is much more aggressive and will attack in larger numbers.

In one specific embodiment, the composition is a pharmaceutical or veterinary composition for treating or preventing insect disease or infections of humans or animals, respectively. Such compositions will comprise at least one double-stranded RNA or RNA construct, or nucleotide sequence or recombinant DNA construct encoding the double-stranded RNA or RNA construct, wherein the double-stranded RNA comprises annealed complementary strands, one of which has a nucleotide sequence which corresponds to a target nucleotide sequence of an insect target gene that causes the disease or infection, and at least one carrier, excipient or diluent suitable for pharmaceutical use.

The composition may be a composition suitable for topical use, such as application on the skin of an animal or human, for example as liquid composition to be applied to the skin as drops, gel, aerosol, or by brushing, or a spray, cream, ointment, etc. for topical application or as transdermal patches.

Alternatively, the insect dsRNA is produced by bacteria (e.g. *lactobacillus*) or fungi (e.g. *Sacharomyces* spp.) which can be included in food and which functions as an oral vaccine against the insect infection.

Other conventional pharmaceutical dosage forms may also be produced, including tablets, capsules, pessaries, transdermal patches, suppositories, etc. The chosen form will depend upon the nature of the target insect and hence the nature of the disease it is desired to treat.

In one specific embodiment, the composition may be a coating, paste or powder that can be applied to a substrate in order to protect said substrate from infestation by insects and/or arachnids. In this embodiment, the composition can be used to protect any substrate or material that is susceptible to infestation by or damage caused by the insect, for example foodstuffs and other perishable materials, and substrates such as wood. Houses and other wood products can be destroyed by termites, powder post beetles, and carpenter ants. The subterranean termite and Formosan termite are the most serious pests of houses in the southern United States and tropical regions. Any harvested plant or animal product can be attacked by insects. Flour beetles, grain weevils, meal moths and other stored product pests will feed on stored grain, cereals, pet food, powdered chocolate, and almost everything else in the kitchen pantry that is not protected. Larvae of clothes moths eat clothes made from animal products, such as fur, silk and wool. Larvae of carpet beetles eat both animal and plant products, including leather, fur, cotton, stored grain, and even museum specimens. Book lice and silverfish are pests of libraries. These insects eat the starchy glue in the bindings of books. Other insects that have invaded houses include cockroaches which eat almost anything. Cockroaches are not known to be a specific transmitter of disease, but they contaminate food and have an unpleasant odor. They are very annoying, and many pest control companies are kept busy in attempts to control them. The most common cockroaches in houses, grocery stores, and restaurants include the German cockroach, American cockroach, Oriental cockroach, and brown banded cockroach.

The nature of the excipients and the physical form of the composition may vary depending upon the nature of the substrate that is desired to treat. For example, the composition may be a liquid that is brushed or sprayed onto or imprinted into the material or substrate to be treated, or a coating that is applied to the material or substrate to be treated.

The present invention further encompasses a method for treating and/or preventing insect infestation on a substrate comprising applying an effective amount of any of the compositions or sprays as described herein to said substrate.

The invention further encompasses a method for treating and/or preventing an insect disease or condition, comprising administering to a subject in need of such treatment and/or prevention, any of the compositions or sprays as herein described comprising at least one double-stranded RNA or double stranded RNA construct comprising annealed complementary strands, one of which has a nucleotide sequence which is complementary to at least part of a nucleotide sequence of an insect target gene of the insect that causes the insect disease or condition. According to a more specific embodiment, said composition or spray to be administered comprises and/or expressing at least one bacterial cell or yeast cell expressing at least one double stranded RNA or double stranded RNA construct as described herein; or comprising and/or expressing at least one nucleotide sequence or recombinant DNA construct as described herein, said RNA or nucleotide sequence being complementary to at least part of a nucleotide sequence of an insect target gene of the insect that causes the insect disease or condition.

In another embodiment of the invention the compositions are used as a insecticide for a plant or for propagation or reproductive material of a plant, such as on seeds. As an example, the composition can be used as an insecticide by spraying or applying it on plant tissue or spraying or mixing it on the soil before or after emergence of the plantlets.

In yet another embodiment, the present invention provides a method for treating and/or preventing insect growth and/or insect infestation of a plant or propagation or reproductive material of a plant, comprising applying an effective amount of any of the compositions or sprays herein described to a plant or to propagation or reproductive material of a plant.

In another embodiment the invention relates to the use of any double-stranded RNA or RNA construct, or nucleotide sequence or recombinant DNA construct encoding the double-stranded RNA or RNA construct, or at least one host cell (e.g. a bacterial or a yeast) expressing a dsRNA of the invention, or a virus encoding a dsRNA described herein, or to any of the compositions or sprays comprising the same, used for controlling insect growth; for preventing insect infestation of plants susceptible to insect infection; or for treating insect infection of plants. Specific plants to be treated for insect infections caused by specific insect species are as described earlier and are encompassed by the said use In a more specific embodiment, the invention relates to the use of a spray comprising at least one host cell or at least one host cell (e.g. a bacterial or a yeast) expressing a dsRNA of the invention, or a virus encoding a dsRNA described herein, or to any of the compositions comprising the same, for controlling insect growth; for preventing insect infestation of plants susceptible to insect infection; or for treating insect infection of plants. Preferably said host cell comprises at least one of the sequences represented by any of SEQ ID NOs 1, 3, 5, 7, 9, 11, 13, 15, 17, 19, 21, 23, 49 to 158, 159, 160-163, 168, 173, 178, 183, 188, 193, 198, 203, 208, 215, 220, 225, 230, 240 to 247, 249, 251, 253, 255, 257, 259, 275 to 472, 473, 478, 483, 488, 493, 498, 503, 508 to 513, 515, 517, 519, 521, 533 to 575, 576, 581, 586, 591, 596, 601, 603, 605, 607, 609, 621 to 767, 768, 773, 778, 783, 788, 793, 795, 797, 799, 801, 813 to 862, 863, 868, 873, 878, 883, 888, 890, 892, 894, 896, 908 to 1040, 1041, 1046, 1051, 1056, 1061, 1066 to 1071, 1073, 1075, 1077, 1079, 1081, 1083, 1085, 1087, 1089, 1091, 1093, 1095, 1097, 1099, 1101, 1103, 1105, 1107, 1109, 1111, 1113, 1161 to 1571, 1572, 1577, 1582, 1587, 1592, 1597, 1602, 1607, 1612, 1617, 1622, 1627, 1632, 1637, 1642, 1647, 1652, 1657, 1662, 1667, 1672, 1677, 1682, 1684, 1686, 1688, 1690, 1692, 1694, 1696, 1698, 1700, 1702, 1704, 1730 to 2039, 2040, 2045, 2050, 2055, 2060, 2065, 2070, 2075, 2080, 2085, 2090, 2095, 2100, 2102, 2104, 2106, 2108, 2120 to 2338, 2339, 2344, 2349, 2354, 2359, 2364, 2366, 2368, 2370, 2372, 2384 to 2460, 2461, 2466, 2471, 2476, 2481 or 2486, or a fragment thereof of at least 17 contiguous nucleotides.

In a further aspect, the invention also provides combinations of methods and compositions for preventing or protecting plants from pest infestation. For instance, one means provides using a combination of the transgenic approach with methods using double stranded RNA molecules and compositions with one or more Bt insecticidal proteins or chemical (organic) compounds that are toxic to the target pest. Another means provides using the transgenic approach combining methods using expression of double stranded RNA molecules in bacteria or yeast and expression of such Bt insecticidal proteins in the same or in distinct bacteria or yeast. According to these approaches, for instance, one insect can be targeted or killed using the RNAi-based method or technology, while the other insect can be targeted or killed using the Bt insecticide or the chemical (organic) insecticide.

Therefore the invention also relates to any of the compositions, sprays or methods for treating plants described herein, wherein said composition comprises a bacterial cell or yeast expressing said RNA molecule and further comprises a pesticidal agent or comprises a bacterial cell or yeast cell comprising or expressing a pesticidal agent (the bacterial or yeast cell can be the same or different from the first ones mentioned), said pesticidal agent selected from the group consisting of a chemical (organic) insecticide, a patatin, a *Bacillus thuringiensis* insecticidal protein, a *Xenorhabdus* insecticidal protein, a *Photorhabdus* insecticidal protein, a *Bacillus laterosporous* insecticidal protein, and a *Bacillus sphearicus* insecticidal protein. Preferably said *Bacillus thuringiensis* insecticidal protein is selected from the group consisting of a Cry1, a Cry3, a TIC851, a CryET170, a Cry22, a binary insecticidal protein CryET33 and CryET34, a binary insecticidal protein CryET80 and CryET76, a binary insecticidal protein TIC100 and TIC101, and a binary insecticidal protein PS149B1.

The spray can be used in a greenhouse or on the field. Typical application rates for bacteria-containing biopestides (e.g. as an emulsifiable suspension) amount to 25-100 liters/ha (10-40 liters/acre) for water based sprays: comprising about 2.5-5 liter of formulated product (emulsifiable suspension) per hectare with the formulated product including about 25% (v/v) of 'bacterial cells' plus 75% (v/v) 'other ingredients'. The amount of bacterial cells are measured in units, e.g. one unit is defined as $10^9$ bacterial cells in 1 ml. Depending on the crop density per hectare and the leaf surface per plant, one liter of formulated product comprises between 0.001 and 10000 units of bacteria, preferably at least 0.001, 0.003, 0.005, 0.007, 0.01, 0.03, 0.05, 0.07, 0.1, 0.3, 0.5, 0.7, more preferably at least 1, 3, 5, 7, 10, 30, 50, 70, 100, 300, 500, 700, or more preferably at least 1000, 3000, 5000, 7000 or 10000 units of bacteria.

For instance, typical plant density for potato crop plants is approximately 4.5 plants per square meter or 45.000 plants per hectare (planting in rows with spacing between rows at 75 cm and spacing between plants within rows at 30 cm). The present invention thus relates to a spray comprising at least 0.001, 0.003, 0.005, 0.007, 0.01, 0.03, 0.05, 0.07, 0.1, 0.3, 0.5, 0.7, more preferably at least 1, 3, 5, 7, 10, 30, 50, 70, 100, 300, 500, 700, or more preferably at least 1000, 3000, 5000, 7000 or 10000 units of bacteria expressing at least one of the dsRNA molecules or dsRNA constructs described herein. The invention further relates to a kit comprising at least one double stranded RNA, or double stranded RNA construct, or nucleotide sequence, or recombinant DNA construct, or host cell, or composition or spray as described earlier for treating insect infection in plants. The kit may be supplied with suitable instructions for use. The instructions may be printed on suitable packaging in which the other components are supplied or may be provided as a separate entity, which may be in the form of a sheet or leaflet for example. The instructions may be rolled or folded for example when in a stored state and may then be unrolled and unfolded to direct use of the remaining components of the kit.

The invention will be further understood with reference to the following non-limiting examples.

BRIEF DESCRIPTION OF THE FIGURES

FIG. 1-LD: Survival of *L. decemlineata* on artificial diet treated with dsRNA. Insects of the second larval stage were fed diet treated with 50 µl of topically-applied solution of dsRNA (targets or gfp control). Diet was replaced with fresh diet containing topically-applied dsRNA after 7 days. The number of surviving insects were assessed at days 2, 5, 7, 8, 9, & 13. The percentage of surviving larvae was calculated relative to day 0 (start of assay). Target LD006: (SEQ ID NO 178); Target LD007 (SEQ ID NO 183); Target LD010 (SEQ ID NO 188); Target LD011 (SEQ ID NO 193); Target LD014 (SEQ ID NO 198); gfp dsRNA (SEQ ID NO 235).

FIG. 2-LD: Survival of *L. decemlineata* on artificial diet treated with dsRNA. Insects of the second larval stage were fed diet treated with 50 µl of topically-applied solution of dsRNA (targets or gfp control). Diet was replaced with fresh diet only after 7 days. The number of surviving insects was assessed at days 2, 5, 6, 7, 8, 9, 12, & 14. The percentage of surviving larvae was calculated relative to day 0 (start of assay). Target LD001 (SEQ ID NO 163); Target LD002 (SEQ ID NO 168); Target LD003 (SEQ ID NO 173); Target LD015 (SEQ ID NO 215); Target LD016 (SEQ ID NO 220); gfp dsRNA (SEQ ID NO 235).

FIG. 3-LD: Average weight of *L. decemlineata* larvae on potato leaf discs treated with dsRNA. Insects of the second larval stage were fed leaf discs treated with 20 µl of a topically-applied solution (10 ng/μl) of dsRNA (target LD002 or gfp). After two days the insects were transferred on to untreated leaves every day.

FIG. 4-LD: Survival of L. decemlineata on artificial diet treated with shorter versions of target LD014 dsRNA and concatemer dsRNA. Insects of the second larval stage were fed diet treated with 50 μl of topically-applied solution of dsRNA (gfp or targets). The number of surviving insects were assessed at days 3, 4, 5, 6, & 7. The percentage of surviving larvae were calculated relative to day 0 (start of assay).

FIG. 5-LD: Survival of L. decemlineata larvae on artificial diet treated with different concentrations of dsRNA of target LD002 (a), target LD007 (b), target LD010 (c), target LD011 (d), target LD014 (e), target LD015 (f), LD016 (g) and target LD027 (h). Insects of the second larval stage were fed diet treated with 50 μl of topically-applied solution of dsRNA. Diet was replaced with fresh diet containing topically-applied dsRNA after 7 days. The number of surviving insects were assessed at regular intervals. The percentage of surviving larvae were calculated relative to day 0 (start of assay).

FIG. 6-LD: Effects of E. coli strains expressing dsRNA target LD010 on survival of larvae of the Colorado potato beetle, Leptinotarsa decemlineata, over time. The two bacterial strains were tested in separate artificial diet-based bioassays: (a) AB301-105(DE3); data points for pGBNJ003 and pGN29 represent average mortality values from 5 different bacterial clones, (b) BL21(DE3); data points for pGBNJ003 and pGN29 represent average mortality values from 5 different and one single bacterial clones, respectively. Error bars represent standard deviations.

FIG. 7-LD: Effects of different clones of *E. coli* strains (a) AB301-105(DE3) and (b) BL21(DE3) expressing dsRNA target LD010 on survival of larvae of the Colorado potato beetle, *Leptinotarsa decemlineata,* 12 days post infestation. Data points are average mortality values for each clone for pGN29 and pGBNJ003. Clone 1 of AB301-105(DE3) harboring plasmid pGBNJ003 showed 100% mortality towards CPB at this timepoint. Error bars represent standard deviations.

FIG. 8-LD: Effects of different clones of *E. coli* strains (a) AB301-105(DE3) and (b) BL21(DE3) expressing dsRNA target LD010 on growth and development of larval survivors of the Colorado potato beetle, *Leptinotarsa decemlineata,* 7 days post infestation. Data points are % average larval weight values for each clone (one clone for pGN29 and five clones for pGBNJ003) based on the data of Table 10-LD. Diet only treatment represents 100% normal larval weight.

FIG. 9-LD: Survival of larvae of the Colorado potato beetle, *Leptinotarsa decemlineata*, on potato plants sprayed by double-stranded RNA-producing bacteria 7 days post infestation. Number of larval survivors were counted and expressed in terms of % mortality. The bacterial host strain used was the RNaseIII-deficient strain AB301-105(DE3). Insect gene target was LD010.

FIG. 10-LD: Growth/developmental delay of larval survivors of the Colorado potato beetle, *Leptinotarsa decemlineata*, fed on potato plants sprayed with dsRNA-producing bacteria 11 days post infestation. The bacterial host strain used was the RNaseIII-deficient strain AB301-105(DE3). Data figures represented as percentage of normal larval weight; 100% of normal larval weight given for diet only treatment. Insect gene target was LD010. Error bars represent standard deviations.

FIG. 11-LD: Resistance to potato damage caused by larvae of the Colorado potato beetle, *Leptinotarsa decemlineata*, by double-stranded RNA-producing bacteria 7 days post infestation. Left, plant sprayed with 7 units of bacteria AB301-105 (DE3) containing the pGN29 plasmid; right, plant sprayed with 7 units of bacteria AB301-105(DE3) containing the pGBNJ003 plasmid. One unit is defined as the equivalent of 1 ml of a bacterial suspension at OD value of 1 at 600 nm. Insect gene target was LD010.

FIG. 12-LD: Survival of *L. decemlineata* adults on potato leaf discs treated with dsRNA. Young adult insects were fed double-stranded-RNA-treated leaf discs for the first two days and were then placed on untreated potato foliage. The number of surviving insects were assessed regularly; mobile insects were recorded as insects which were alive and appeared to move normally; moribund insects were recorded as insects which were alive but appeared sick and slow moving—these insects were not able to right themselves once placed on their backs. Target LD002 (SEQ ID NO 168); Target LD010 (SEQ ID NO 188); Target LD014 (SEQ ID NO 198); Target LD016 (SEQ ID NO 220); gfp dsRNA (SEQ ID NO 235).

FIG. 13-LD: Effects of bacterial produced target double-stranded RNA against larvae of *L. decemlineata*. Fifty μl of an OD 1 suspension of heat-treated bacteria AB301-105 (DE3) expressing dsRNA (SEQ ID NO 188) was applied topically onto the solid artificial diet in each well of a 48-well plate. CPB larvae at L2 stage were placed in each well. At day 7, a picture was taken of the CPB larvae in a plate containing (a) diet with bacteria expressing target 10 double-stranded RNA, (b) diet with bacteria harboring the empty vector pGN29, and, (c) diet only.

FIG. 14-LD: Effects on CPB larval survival and growth of different amounts of inactivated *E. coli* AB301-105(DE3) strain harboring plasmid pGBNJ003 topically applied to potato foliage prior to insect infestation. Ten L1 larvae were fed treated potato for 7 days. Amount of bacterial suspension sprayed on plants: 0.25 U, 0.08 U, 0.025 U, 0.008 U of target 10 and 0.25 U of pGN29 (negative control; also included is Milli-Q water). One unit (U) is defined as the equivalent bacterial amount present in 1 ml of culture with an optical density value of 1 at 600 nm. A total volume of 1.6 ml was sprayed on to each plant. Insect gene target was LD010.

FIG. 15-LD: Resistance to potato damage caused by CPB larvae by inactivated *E. coli* AB301-105(DE3) strain harboring plasmid pGBNJ003 seven days post infestation. (a) water, (b) 0.25 U *E. coli* AB301-105(DE3) harboring pGN29, (c) 0.025 U *E. coli* AB301-105(DE3) harboring pGBNJ003, (d) 0.008 U *E. coli* AB301-105(DE3) harboring pGBNJ003. One unit (U) is defined as the equivalent bacterial amount present in 1 ml of culture with an optical density value of 1 at 600 nm. A total volume of 1.6 ml was sprayed on to each plant. Insect gene target was LD010.

FIG. 1-PC: Effects of ingested target dsRNAs on survival and growth of *P. cochleariae* larvae. Neonate larvae were fed oilseed rape leaf discs treated with 25 μl of topically-applied solution of 0.1 μg/μl dsRNA (targets or gfp control). After 2 days, the insects were transferred onto fresh dsRNA-treated leaf discs. At day 4, larvae from one replicate for every treatment were collected and placed in a Petri dish containing fresh untreated oilseed rape foliage. The insects were assessed at days 2, 4, 7, 9 & 11. (a) Survival of *E. varivestis* larvae on oilseed rape leaf discs treated with dsRNA. The percentage of surviving larvae was calculated relative to day 0 (start of assay). (b) Average weights of *P. cochleariae* larvae on oilseed rape leaf discs treated with dsRNA. Insects from each replicate were weighed together and the average weight per larva determined. Error bars represent standard deviations. Target 1: SEQ ID NO 473; target 3: SEQ ID NO 478; target 5: SEQ ID NO 483-; target 10: SEQ ID NO 488; target 14: SEQ ID NO 493; target 16: SEQ ID NO 498; target 27: SEQ ID NO 503; gfp dsRNA: SEQ ID NO 235.

FIG. 2-PC: Survival of *P. cochleariae* on oilseed rape leaf discs treated with different concentrations of dsRNA of (a) target PC010 and (b) target PC027. Neonate larvae were placed on leaf discs treated with 25 μl of topically-applied solution of dsRNA. Insects were transferred to fresh treated leaf discs at day 2. At day 4 for target PC010 and day 5 for target PC027, the insects were transferred to untreated leaves. The number of surviving insects were assessed at days 2, 4, 7, 8, 9 & 11 for PC010 and 2, 5, 8, 9 & 12 for PC027. The percentage of surviving larvae was calculated relative to day 0 (start of assay).

FIG. 3-PC: Effects of *E. coli* strain AB301-105(DE3) expressing dsRNA target PC010 on survival of larvae of the mustard leaf beetle, *P. cochleariae*, over time. Data points for each treatment represent average mortality values from 3 different replicates. Error bars represent standard deviations. Target 10: SEQ ID NO 488.

FIG. 4-PC: Selectivity of RNAi-by-feeding technology against two chrysomelids, Colorado potato beetle and mustard leaf beetle. A: DNA nucleotide sequence comparison between LD010 SEQ ID NO 2487 (CPB-specific) and PC010 SEQ ID NO 2488 (MLB-specific) gene fragment. Identical nucleotide sequences (75%) are indicated in grey shading. B: Schematic overview of the RNA concatemer where A and B represent cpb or gfp, and mlb or gfp, moieties, respectively. C and D: Effect of target gene 010 orthologues on survival of larvae of the CPB (C) or MLB (D) in feeding bioassays (the sense strand of dsRNA corresponding to cpb-mlb concatemer is given in SEQ ID NO 2489; the sense strand of dsRNA corresponding to cpb-gfp concatemer is given in SEQ ID NO 2490; the sense strand of dsRNA corresponding to gfp-mlb concatemer is given in SEQ ID NO 2491; the sense strand of dsRNA corresponding to gfp-gfp concatemer is given in SEQ ID NO 2492). Young L2 larvae were placed on diet containing heat-inactivated recombinant bacteria with expressed dsRNAs. Twenty-four CPB and thirty-six MLB larvae were used per treatment. Amount of heat-inactivated bacteria exposed to each larva was 1 unit/cm$^2$.

FIG. 1-EV: Survival of *E. varivestis* larvae on bean leaf discs treated with dsRNA. Neonate larvae were fed bean leaf discs treated with 25 μl of topically-applied solution of 1 μg/μl dsRNA (targets or gfp control). After 2 days, the insects were transferred onto fresh dsRNA-treated leaf discs. At day 4, larvae from one treatment were collected and placed in a plastic box containing fresh untreated bean foliage. The insects were assessed for mortality at days 2, 4, 6, 8 & 10. The percentage of surviving larvae was calculated relative to day 0 (start of assay). Target 5: SEQ ID NO 576; target 10: SEQ ID NO 586; target 15: SEQ ID NO 591; target 16: SEQ ID NO 596; gfp dsRNA: SEQ ID NO 235.

FIG. 2-EV: Effects of ingested target dsRNAs on survival of *E. varivestis* adults and resistance to snap bean foliar insect damage. (a) Survival of *E. varivestis* adults on bean leaf treated with dsRNA. Adults were fed bean leaf discs treated with 75 μl of topically-applied solution of 0.1 μg/μl dsRNA (targets or gfp control). After 24 hours, the insects were transferred onto fresh dsRNA-treated leaf discs. After a further 24 hours, adults from one treatment were collected and placed in a plastic box containing potted fresh untreated whole bean plants. The insects were assessed for mortality at days 4, 5, 6, 7, 8, & 11. The percentage of surviving adults was calculated relative to day 0 (start of assay). Target 10: SEQ ID NO 586; target 15: SEQ ID NO 591; target 16: SEQ ID NO 596; gfp dsRNA: SEQ ID NO 235. (b) Resistance to bean foliar damage caused by adults of the *E. varivestis* by dsRNA. Whole plants containing insects from one treatment (see (a)) were checked visually for foliar damage on day 9. (i) target 10; (ii) target 15; (iii) target 16; (iv) gfp dsRNA; (v) untreated.

FIG. 1-TC: Survival of *T. castaneum* larvae on artificial diet treated with dsRNA of target 14. Neonate larvae were fed diet based on a flour/milk mix with 1 mg dsRNA target 14. Control was water (without dsRNA) in diet. Four replicates of 10 first instar larvae per replicate were performed for each treatment. The insects were assessed for survival as average percentage means at days 6, 17, 31, 45 and 60. The percentage of surviving larvae was calculated relative to day 0 (start of assay). Error bars represent standard deviations. Target TC014: SEQ ID NO 878.

FIG. 1-MP: Effect of ingested target 27 dsRNA on the survival of *Myzus persicae* nymphs. First instars were placed in feeding chambers containing 50 μl of liquid diet with 2 μg/μl dsRNA (target 27 or gfp dsRNA control). Per treatment, 5 feeding chambers were set up with 10 instars in each feeding chamber. Number of survivors were assessed at 8 days post start of bioassay. Error bars represent standard deviations. Target MP027: SEQ ID NO 1061; gfp dsRNA: SEQ ID NO 235.

FIG. 1-NL: Survival of *Nilaparvata lugens* on liquid artificial diet treated with dsRNA. Nymphs of the first to second larval stage were fed diet supplemented with 2 mg/ml solution of dsRNA targets in separate bioassays: (a) NL002, NL003, NL005, NL010; (b) NL009, NL016; (c) NL014, NL018; (d) NL013, NL015, NL021. Insect survival on targets were compared to diet only and diet with gfp dsRNA control at same concentration. Diet was replaced with fresh diet containing dsRNA every two days. The number of surviving insects were assessed every day FIG. 2-NL: Survival of *Nilaparvata lugens* on liquid artificial diet treated with different concentrations of target dsRNA NL002. Nymphs of the first to second larval stage were fed diet supplemented with 1, 0.2, 0.08, and 0.04 mg/ml (final concentration) of NL002. Diet was replaced with fresh diet containing dsRNA every two days. The numbers of surviving insects were assessed every day.

EXAMPLES

Example 1

Silencing *C. elegans* Target Genes in *C. elegans* in High Throughput Screening A *C. elegans* genome wide library was prepared in the pGN9A vector (WO 01/88121) between two identical T7-promoters and terminators, driving its expression in the sense and antisense direction upon expression of the T7 polymerase, which was induced by IPTG.

This library was transformed into the bacterial strain AB301-105 (DE3) in 96 well plate format. For the genome wide screening, these bacterial cells were fed to the nuclease deficient *C. elegans* nuc-1 (e1392) strain.

Feeding the dsRNA produced in the bacterial strain AB301-105 (DE3), to *C. elegans* nuc-1 (e1392) worms, was performed in a 96 well plate format as follows: nuc-1 eggs were transferred to a separate plate and allowed to hatch simultaneously at 20° C. for synchronization of the L1 generation. 96 well plates were filled with 100 μL liquid growth medium comprising IPTG and with 10 μL bacterial cell culture of OD$_{600}$1 AB301-105 (DE3) of the *C. elegans* dsRNA library carrying each a vector with a *C. elegans* genomic fragment for expression of the dsRNA. To each well, 4 of the synchronized L1 worms were added and were incubated at 25° C. for at least 4 to 5 days. These experiments were performed in quadruplicate. In the screen 6 controls were used:

pGN29=negative control, wild type
pGZ1=unc-22=twitcher phenotype
pGZ18=chitin synthase=embryonic lethal
pGZ25=pos-1=embryonic lethal
pGZ59=bli-4D=acute lethal
ACC=acetyl co-enzyme A carboxylase=acute lethal After 5 days, the phenotype of the *C. elegans* nuc-1 (e1392) worms fed with the bacteria producing dsRNA were compared to the phenotype of worms fed with the empty vector (pGN29) and the other controls. The worms that were fed with the dsRNA were screened for lethality (acute or larval) lethality for the parent (Po) generation, (embryonic) lethality for the first filial (F1) generation, or for growth retardation of Po as follows: (i) Acute lethality of Po: L1's have not developed and are dead, this phenotype never gives progeny and the well looks quite empty; (ii) (Larval) lethality of Po: Po died in a later stage than L1, this phenotype also never gives progeny. Dead larvae or dead adult worms are found in the wells; (iii) Lethality for F1: L1's have developed until adult stage and are still alive. This phenotype has no progeny. This can be due to sterility, embryonic lethality (dead eggs on bottom of well), embryonic arrest or larval arrest (eventually ends up being lethal): (iv) Arrested in growth and growth retardation/delay: Compared to a well with normal development and normal # of progeny.

For the target sequences presented in Table 1A, it was concluded that dsRNA mediated silencing of the *C. elegans* target gene in nematodes, such as *C. elegans*, had a fatal effect on the growth and viability of the worm.

Subsequent to the above dsRNA silencing experiment, a more detailed phenotyping experiment was conducted in *C. elegans* in a high throughput format on 24 well plates. The dsRNA library produced in bacterial strain AB301-105 (DE3), as described above, was fed to *C. elegans* nuc-1 (e1392) worms on 24 well plates as follows: nuc-1 eggs were transferred to a separate plate and allowed to hatch simultaneously at 20 C for synchronization of the L1 generation. Subsequently 100 of the synchronized L1 worms were soaked in a mixture of 500 µL S-complete fed medium, comprising 5 µg/mL cholesterol, 4 µL/mL PEG and 1 mM IPTG, and 500 µL of bacterial cell culture of $OD_{600}1$ AB301-105 (DE3) of the *C. elegans* dsRNA library carrying each a vector with a *C. elegans* genomic fragment for expression of the dsRNA. The soaked L1 worms were rolled for 2 hours at 25 C.

After centrifugation and removal of 950 µL of the supernatant, 5 µL of the remaining and resuspended pellet (comprising about 10 to 15 worms) was transferred in the middle of each well of a 24 well plate, filled with a layer of agar LB broth. The inoculated plate was incubated at 25° C. for 2 days. At the adult stage, 1 adult worm was singled and incubated at 25° C. for 2 days for inspection of its progeny. The other adult worms are inspected in situ on the original 24 well plate. These experiments were performed in quadruplicate.

This detailed phenotypic screen was repeated with a second batch of worms, the only difference being that the worms of the second batch were incubated at 20 C for 3 days.

The phenotype of the worms fed with *C. elegans* dsRNA was compared to the phenotype of *C. elegans* nuc-1 (e1392) worms fed with the empty vector.

Based on this experiment, it was concluded that silencing the *C. elegans* target genes as represented in Table 1A had a fatal effect on the growth and viability of the worm and that the target gene is essential to the viability of nematodes. Therefore these genes are good target genes to control (kill or prevent from growing) nematodes via dsRNA mediated gene silencing. Accordingly, the present invention encompasses the use of nematode orthologues of the above *C. elegans* target gene, to control nematode infestation, such as nematode infestation of plants.

Example 2

Identification of *D. melanogaster* Orthologues

As described above in Example 1, numerous *C. elegans* lethal sequences were identified and can be used for identifying orthologues in other species and genera. For example, the *C. elegans* lethal sequences can be used to identify orthologous *D. melanogasters* sequences. That is, each *C. elegans* sequence can be queried against a public database, such as GenBank, for orthologous sequences in *D. melanogaster*. Potential *D. melanogaster* orthologues were selected that share a high degree of sequence homology (E value preferably less than or equal to 1 E-30) and the sequences are blast reciprocal best hits, the latter means that the sequences from different organisms (e.g. *C. elegans* and *D. melanogaster*) are each other's top blast hits. For example, sequence C from *C. elegans* is compared against sequences in *D. melanogaster* using BLAST. If sequence C has the *D. melanogaster* sequence D as best hit and when D is compared to all the sequences of *C. elegans*, also turns out to be sequence C, then D and C are reciprocal best hits. This criterium is often used to define orthology, meaning similar sequences of different species, having similar function. The *D. melanogaster* sequence identifiers are represented in Table 1A.

Example 3

*Leptinotarsa decemlineata* (Colorado Potato Beetle)

A. Cloning Partial Gene Sequences from *Leptinotarsa decemlineata*

High quality, intact RNA was isolated from 4 different larval stages of *Leptinotarsa decemlineata* (Colorado potato beetle; source: Jeroen van Schaik, Entocare CV Biologische Gewasbescherming, Postbus 162, 6700 AD Wageningen, the Netherlands) using TRIzol Reagent (Cat. Nr. 15596-026/ 15596-018, Invitrogen, Rockville, Md., USA) following the manufacturer's instructions. Genomic DNA present in the RNA preparation was removed by DNase treatment following the manufacturer's instructions (Cat. Nr. 1700, Promega). cDNA was generated using a commercially available kit (SuperScript™ III Reverse Transcriptase, Cat. Nr. 18080044, Invitrogen, Rockville, Md., USA) following the manufacturer's instructions.

To isolate cDNA sequences comprising a portion of the LD001, LD002, LD003, LD006, LD007, LD010, LD011, LD014, LD015, LD016, LC018 and LD027 genes, a series of PCR reactions with degenerate primers were performed using Amplitaq Gold (Cat. Nr. N8080240, Applied Biosystems) following the manufacturer's instructions.

The sequences of the degenerate primers used for amplification of each of the genes are given in Table 2-LD, which displays *Leptintarsa decemlineata* target genes including primer sequences and cDNA sequences obtained. These primers were used in respective PCR reactions with the following conditions: 10 minutes at 95° C., followed by 40 cycles of 30 seconds at 95° C., 1 minute at 55° C. and 1 minute at 72° C., followed by 10 minutes at 72° C. The resulting PCR fragments were analyzed on agarose gel, purified (QIAquick Gel Extraction kit, Cat. Nr. 28706, Qiagen), cloned into the pCR8/GW/topo vector (Cat. Nr. K2500 20, Invitrogen), and sequenced. The sequences of the resulting PCR products are represented by the respective SEQ ID NOs as given in Table 2-LD and are referred to as the partial sequences. The complete cDNA sequence of LD010 is represented by SEQ ID NO 2493. The corresponding partial amino acid sequences are represented by the respective SEQ ID NOs as given in Table 3-LD, where the start of the reading frame is indicated in brackets. The complete amino acid sequence of LD010 is represented by SEQ ID NO 2494.

B. dsRNA Production of the *Leptinotarsa decemlineata* Genes dsRNA was synthesized in milligram amounts using the commercially available kit T7 Ribomax™ Express RNAi System (Cat. Nr. P1700, Promega). First two separate single 5' T7 RNA polymerase promoter templates were generated in two separate PCR reactions, each reaction containing the target sequence in a different orientation relative to the T7 promoter.

For each of the target genes, the sense T7 template was generated using specific T7 forward and specific reverse primers. The sequences of the respective primers for amplifying the sense template for each of the target genes are given in Table 8-LD. The conditions in the PCR reactions were as follows: 4 minutes at 95° C., followed by 35 cycles of 30 seconds at 95° C., 30 seconds at 55° C. and 1 minute at 72° C., followed by 10 minutes at 72° C. The anti-sense T7 template was generated using specific forward and specific T7 reverse primers in a PCR reaction with the same conditions as described above. The sequences of the respective primers for amplifying the anti-sense template for each of the target genes are given in Table 8-LD. The resulting PCR products were analyzed on agarose gel and purified by PCR purification kit (Qiaquick PCR Purification Kit, Cat. Nr. 28106, Qiagen) and $NaClO_4$ precipitation. The generated T7 forward and reverse templates were mixed to be transcribed and the resulting RNA strands were annealed, DNase and RNase treated, and purified by sodium acetate, following the manufacturer's instructions. The sense strand of the resulting dsRNA for each of the target genes is given in Table 8-LD. Table 8-LD displays sequences for preparing ds RNA fragments of *Leptinotarsa decemlineata* target sequences and concatemer sequences, including primer sequences.

C. Screening dsRNA Targets Using Artificial Diet for Activity Against *Leptinotarsa decemlineata*

Artificial diet for the Colorado potato beetle was prepared as follows (adapted from Gelman et al., 2001, J. Ins. Sc., vol. 1, no. 7, 1-10): water and agar were autoclaved, and the remaining ingredients (shown in Table A below) were added when the temperature dropped to 55° C. At this temperature, the ingredients were mixed well before the diet was aliquoted into 24-well plates (Nunc) with a quantity of 1 ml of diet per well. The artificial diet was allowed to solidify by cooling at room temperature. Diet was stored at 4° C. for up to three weeks.

TABLE A

Ingredients for Artificial diet

| Ingredients | Volume for 1 L |
|---|---|
| water | 768 ml |
| agar | 14 g |
| rolled oats | 40 g |
| Torula yeast | 60 g |
| lactalbumin hydrolysate | 30 g |
| casein | 10 g |
| fructose | 20 g |
| Wesson salt mixture | 4 g |
| tomato fruit powder | 12.5 g |
| potato leaf powder | 25 g |
| b-sitosterol | 1 g |
| sorbic acid | 0.8 g |
| methyl paraben | 0.8 g |
| Vanderzant vitamin mix | 12 g |
| neomycin sulfate | 0.2 g |
| aureomycin | 0.130 g |
| rifampicin | 0.130 g |
| chloramphenicol | 0.130 g |
| nystatin | 0.050 g |
| soybean oil | 2 ml |
| wheat germ oil | 2 ml |

Fifty μl of a solution of dsRNA at a concentration of 1 mg/ml was applied topically onto the solid artificial diet in the wells of the multiwell plate. The diet was dried in a laminair flow cabin. Per treatment, twenty-four Colorado potato beetle larvae ($2^{nd}$ stage), with two insects per well, were tested. The plates were stored in the insect rearing chamber at 25±2° C., 60% relative humidity, with a 16:8 hours light:dark photoperiod. The beetles were assessed as live or dead every 1, 2 or 3 days. After seven days, for targets LD006, LD007, LD010, LD011, and LD014, the diet was replaced with fresh diet with topically applied dsRNA at the same concentration (1 mg/ml); for targets LD001, LD002, LD003, LD015, and LD016, the diet was replaced with fresh diet only. The dsRNA targets were compared to diet only or diet with topically applied dsRNA corresponding to a fragment of the GFP (green fluorescent protein) coding sequence (SEQ ID NO 235).

Feeding artificial diet containing intact naked dsRNAs to *L. decemlineata* larvae resulted in significant increases in larval mortalities as indicated in two separate bioassays (FIGS. 1LD-2LD).

All dsRNAs tested resulted ultimately in 100% mortality after 7 to 14 days. Diet with or without GFP dsRNA sustained the insects throughout the bioassays with very little or no mortality.

Typically, in all assays observed, CPB second-stage larvae fed normally on diet with or without dsRNA for 2 days and molted to the third larval stage. At this new larval stage the CPB were observed to reduce significantly or stop altogether their feeding, with an increase in mortality as a result.

D. Bioassay of dsRNA Targets Using Potato Leaf Discs for Activity Against the *Leptinotarsa decemlineata*

An alternative bioassay method was employed using potato leaf material rather than artificial diet as food source for CPB. Discs of approximately 1.1 cm in diameter (or 0.95 $cm^2$) were cut out off leaves of 2 to 3-week old potato plants using a suitably-sized cork borer. Treated leaf discs were prepared by applying 20 μl of a 10 ng/μl solution of target LD002 dsRNA or control gfp dsRNA on the adaxial leaf surface. The leaf discs were allowed to dry and placed individually in 24 wells of a 24-well multiplate (Nunc). A single second-larval stage CPB was placed into each well, which was then covered with tissue paper and a multiwell plastic lid. The plate containing the insects and leaf discs were kept in an insect chamber at 28° C. with a photoperiod of 16 h light/8 h dark. The insects were allowed to feed on the leaf discs for 2 days after which the insects were transferred to a new plate containing fresh treated leaf discs. Thereafter, the insects were transferred to a plate containing untreated leaf discs every day until day 7. Insect mortality and weight scores were recorded.

Feeding potato leaf discs with surface-applied intact naked dsRNA of target LD002 to *L. decemlineata* larvae resulted in a significant increase in larval mortalities (i.e. at day 7 all insects were dead; 100% mortality) whereas control gfp dsRNA had no effect on CPB survival. Target LD002 dsRNA severely affected the growth of the larvae after 2 to 3 days whereas the larvae fed with gfp dsRNA at the same concentration developed as normal (FIG. 3-LD).

E. Screening Shorter Versions of dsRNAs Using Artificial Diet for Activity Against *Leptinotarsa decemlineata*

This example exemplifies the finding that shorter (60 or 100 bp) dsRNA fragments on their own or as concatemer constructs are sufficient in causing toxicity towards the Colorado potato beetle.

LD014, a target known to induce lethality in Colorado potato beetle, was selected for this example. This gene encodes a V-ATPase subunit E (SEQ ID NO 15).

A 100 base pair fragment, LD014_F1, at position 195-294 on SEQ ID NO 15 (SEQ ID NO 159) and a 60 base pair fragment, LD014_F2, at position 235-294 on SEQ ID NO 15 (SEQ ID NO 160) were further selected.

Two concatemers of 300 base pairs, LD014_C1 and LD014_C2, were designed (SEQ ID NO 161 and SEQ ID NO 162). LD014_C1 contained 3 repeats of the 100 base pair fragment described above (SEQ ID NO 159) and LD014_C2 contained 5 repeats of the 60 base pair fragment described above (SEQ ID NO 160).

The fragments LD014_F1 and LD014_F2 were synthesized as sense and antisense primers. These primers were annealed to create the double strands DNA molecules prior to cloning. XbaI and XmaI restrictions sites were included at the 5" and 3" ends of the primers, respectively, to facilitate the cloning.

The concatemers were made as 300 base pairs synthetic genes. XbaI and XmaI restrictions sites were included at the 5' and 3' ends of the synthetic DNA fragments, respectively, to facilitate the cloning.

The 4 DNA molecules, i.e. the 2 single units (LD014_F1 & LD014_F2) and the 2 concatemers (LD014_C1 & LD014_C2), were digested with XbaI and XmaI and subcloned in pBluescriptII SK+ linearised by XbaI and XmaI digests, resulting in recombinant plasmids p1, p2, p3, & p4, respectively.

Double-stranded RNA production: dsRNA was synthesized using the commercially available kit T7 Ribomax™ Express RNAi System (Cat. Nr. P1700, Promega). First two separate single 5' T7 RNA polymerase promoter templates were generated in two separate PCR reactions, each reaction containing the target sequence in a different orientation relative to the T7 promoter. For LD014_F1, the sense T7 template was generated using the specific T7 forward primer oGBM159 and the specific reverse primer oGBM164 (represented herein as SEQ ID NO 204 and SEQ ID NO 205, respectively) in a PCR reaction with the following conditions: 4 minutes at 95° C., followed by 35 cycles of 30 seconds at 95° C., 30 seconds at 55° C. and 1 minute at 72° C., followed by 10 minutes at 72° C. The anti-sense T7 template was generated using the specific forward primer oGBM163 and the specific T7 reverse primer oGBM160 (represented herein as SEQ ID NO 206 and SEQ ID NO 207, respectively) in a PCR reaction with the same conditions as described above. The resulting PCR products were analyzed on agarose gel and purified by PCR purification kit (Qiaquick PCR Purification Kit, Cat. Nr. 28106, Qiagen) and $NaClO_4$ precipitation. The generated T7 forward and reverse templates were mixed to be transcribed and the resulting RNA strands were annealed, Dnase and Rnase treated, and purified by sodium acetate, following the manufacturer's instructions. The sense strand of the resulting dsRNA is herein represented by SEQ ID NO 203.

For LD014_F2, the sense T7 template was generated using the specific T7 forward primer oGBM161 and the specific reverse primer oGBM166 (represented herein as SEQ ID NO 209 and SEQ ID NO 210, respectively) in a PCR reaction with the following conditions: 4 minutes at 95° C., followed by 35 cycles of 30 seconds at 95° C., 30 seconds at 55° C. and 1 minute at 72° C., followed by 10 minutes at 72° C. The anti-sense T7 template was generated using the specific forward primer oGBM165 and the specific T7 reverse primer oGBM162 (represented herein as SEQ ID NO 211 and SEQ ID NO 212, respectively) in a PCR reaction with the same conditions as described above. The resulting PCR products were analyzed on agarose gel and purified by PCR purification kit (Qiaquick PCR Purification Kit, Cat. Nr. 28106, Qiagen) and $NaClO_4$ precipitation. The generated T7 forward and reverse templates were mixed to be transcribed and the resulting RNA strands were annealed, Dnase and Rnase treated, and purified by sodium acetate, following the manufacturer's instructions. The sense strand of the resulting dsRNA is herein represented by SEQ ID NO 208.

Also for the concatemers, separate single 5' T7 RNA polymerase promoter templates were generated in two separate PCR reactions, each reaction containing the target sequence in a different orientation relative to the T7 promoter. The recombinant plasmids p3 and p4 containing LD014_C1 & LD014_C2 were linearised with XbaI or XmaI, the two linear fragments for each construct purified and used as template for the in vitro transcription assay, using the T7 promoters flanking the cloning sites. Double-stranded RNA was prepared by in vitro transcription using the T7 RiboMAX™ Express RNAi System (Promega). The sense strands of the resulting dsRNA for LD014_C1 and LD014_C2 are herein represented by SEQ ID NO 213 and 2114, respectively.

Shorter sequences of target LD014 and concatemers were able to induce lethality in *Leptinotarsa decemlineata*, as shown in FIG. 4-LD.

F. Screening dsRNAs at Different Concentrations Using Artificial Diet for Activity Against *Leptinotarsa decemlineata*

Fifty μl of a solution of dsRNA at serial ten-fold concentrations from 1 μg/μl (for target LD027 from 0.1 μg/μl) down to 0.01 ng/μl was applied topically onto the solid artificial diet in the wells of a 24-well plate (Nunc). The diet was dried in a laminair flow cabin. Per treatment, twenty-four Colorado potato beetle larvae ($2^{nd}$ stage), with two insects per well, were tested. The plates were stored in the insect rearing chamber at 25±2° C., 60% relative humidity, with a 16:8 hours light:dark photoperiod. The beetles were assessed as live or dead at regular intervals up to day 14. After seven days, the diet was replaced with fresh diet with topically applied dsRNA at the same concentrations. The dsRNA targets were compared to diet only.

Feeding artificial diet containing intact naked dsRNAs of different targets to *L. decemlineata* larvae resulted in high larval mortalities at concentrations as low as between 0.1 and 10 ng dsRNA/μl as shown in FIG. 5-LD.

G. Cloning of a CPB Gene Fragment in a Vector Suitable for Bacterial Production of Insect-Active Double-Stranded RNA While any efficient bacterial promoter may be used, a DNA fragment corresponding to an CPB gene target was cloned in a vector for the expression of double-stranded RNA in a bacterial host (See WO 00/01846).

The sequences of the specific primers used for the amplification of target genes are provided in Table 8-LD. The template used is the pCR8/GW/topo vector containing any of target sequences. The primers are used in a PCR reaction with the following conditions: 5 minutes at 98° C., followed by 30 cycles of 10 seconds at 98° C., 30 seconds at 55° C. and 2 minutes at 72° C., followed by 10 minutes at 72° C. The resulting PCR fragment is analyzed on agarose gel, purified (QIAquick Gel Extraction kit, Cat. Nr. 28706, Qiagen), blunt-end cloned into Srf I-linearized pGNA49A vector (reference to WO00188121A1), and sequenced. The sequence of the resulting PCR product corresponds to the respective sequence as given in Table 8-LD. The recombinant vector harboring this sequence is named pGBNJ003.

The sequences of the specific primers used for the amplification of target gene fragment LD010 are provided in Table 8-LD (forward primer SEQ ID NO 191 and reverse primer SEQ ID NO 190). The template used was the pCR8/GW/topo vector containing the LD010 sequence (SEQ ID NO 11). The primers were used in a PCR reaction with the following conditions: 5 minutes at 98° C., followed by 30 cycles of 10 seconds at 98° C., 30 seconds at 55° C. and 2 minutes at 72° C., followed by 10 minutes at 72° C. The resulting PCR fragment was analyzed on agarose gel, purified (QIAquick Gel Extraction kit, Cat. Nr. 28706, Qiagen), blunt-end cloned into Srf I-linearized pGNA49A vector (reference to WO 00/188121A1), and sequenced. The sequence of the resulting PCR product corresponds to SEQ ID NO 188 as given in Table 8-LD. The recombinant vector harboring this sequence was named pGBNJ003.

H. Expression and Production of a Double-Stranded RNA Target in Two Strains of *Escherichia coli*: (1) AB301-105 (DE3), and, (2) BL21(DE3)

The procedures described below were followed in order to express suitable levels of insect-active double-stranded RNA of target LD010 in bacteria. An RNaseIII-deficient strain, AB301-105(DE3), was used in comparison to wild-type RNaseIII-containing bacteria, BL21(DE3).

Transformation of AB301-105(DE3) and BL21(DE3)

Three hundred ng of the plasmid was added to and gently mixed in a 50 µl aliquot of ice-chilled chemically competent *E. coli* strain AB301-105(DE3) or BL21(DE3). The cells were incubated on ice for 20 minutes before subjecting them to a heat shock treatment of 37° C. for 5 minutes, after which the cells were placed back on ice for a further 5 minutes. Four hundred and fifty µl of room temperature SOC medium was added to the cells and the suspension incubated on a shaker (250 rpm) at 37° C. for 1 hour. One hundred µl of the bacterial cell suspension was transferred to a 500 ml conical flask containing 150 ml of liquid Luria-Bertani (LB) broth supplemented with 100 µg/ml carbenicillin antibiotic. The culture was incubated on an Innova 4430 shaker (250 rpm) at 37° C. overnight (16 to 18 hours).

Chemical Induction of Double-Stranded RNA Expression in AB301-105(DE3) and BL21(DE3)

Expression of double-stranded RNA from the recombinant vector, pGBNJ003, in the bacterial strain AB301-105(DE3) or BL21(DE3) was made possible since all the genetic components for controlled expression are present. In the presence of the chemical inducer isopropylthiogalactoside, or IPTG, the T7 polymerase will drive the transcription of the target sequence in both antisense and sense directions since these are flanked by oppositely oriented T7 promoters.

The optical density at 600 nm of the overnight bacterial culture was measured using an appropriate spectrophotometer and adjusted to a value of 1 bp the addition of fresh LB broth. Fifty ml of this culture was transferred to a 50 ml Falcon tube and the culture then centrifuged at 3000 g at 15° C. for 10 minutes. The supernatant was removed and the bacterial pellet resuspended in 50 ml of fresh S complete medium (SNC medium plus 5 µg/ml cholesterol) supplemented with 100 µg/ml carbenicillin and 1 mM IPTG. The bacteria were induced for 2 to 4 hours at room temperature.

Heat Treatment of Bacteria

Bacteria were killed by heat treatment in order to minimize the risk of contamination of the artificial diet in the test plates. However, heat treatment of bacteria expressing double-stranded RNA is not a prerequisite for inducing toxicity towards the insects due to RNA interference. The induced bacterial culture was centrifuged at 3000 g at room temperature for 10 minutes, the supernatant discarded and the pellet subjected to 80° C. for 20 minutes in a water bath. After heat treatment, the bacterial pellet was resuspended in 1.5 ml MilliQ water and the suspension transferred to a microfuge tube. Several tubes were prepared and used in the bioassays for each refreshment. The tubes were stored at −20° C. until further use.

I. Laboratory Trials to Test *Escherichia coli* Expressing dsRNA Target LD010 Against *Leptinotarsa decemlineata*

Two bioassay methods were employed to test double-stranded RNA produced in *Escherichia coli* against larvae of the Colorado potato beetle: (1) artificial diet-based bioassay, and, (2) plant-based bioassay.

Artificial Diet-Based Bioassays

Artificial diet for the Colorado potato beetle was prepared as described previously in Example 3C. A half milliliter of diet was dispensed into each of the wells of a 48-well multiwell test plate (Nunc). For every treatment, fifty μl of an OD 1 suspension of heat-treated bacteria (which is equivalent to approximately $5\times10^7$ bacterial cells) expressing dsRNA was applied topically onto the solid diet in the wells and the plates were allowed to dry in a laminair flow cabin. Per treatment, forty-eight $2^{nd}$ stage Colorado potato beetle larvae, one in each well containing diet and bacteria, were tested. Each row of a plate (i.e. 8 wells) was considered as one replicate. The plates were kept in the insect rearing chamber at 25±2° C., 60±5% relative humidity, with a 16:8 hours light:dark photoperiod. After every 4 days, the beetles were transferred to fresh diet containing topically-applied bacteria. The beetles were assessed as alive or dead every one or three days post infestation. For the survivors, growth and development in terms of larval weight was recorded on day 7 post infestation.

For RNaseIII-deficient *E. coli* strain AB301-105(DE3), bacteria containing plasmid pGBNJ003 and those containing the empty vector pGN29 (reference to WO 00/188121A1) were tested in bioassays for CPB toxicity. Bacteria harboring the pGBNJ003 plasmid showed a clear increase in insect mortality with time, whereas little or no mortality was observed for pGN29 and diet only control (FIGS. 6*a*-LD & 7*a*-LD). The growth and development of Colorado potato beetle larval survivors, 7 days after feeding on artificial diet containing bacteria expressing dsRNA target LD010, was severely impeded (Table 10-LD, FIG. 8*a*-LD, FIG. 13-LD).

For *E. coli* strain BL21(DE3), bacteria containing plasmid pGBNJ003 and those containing the empty vector pGN29 were tested against the Colorado potato beetle larvae. Similar detrimental effects were observed on larvae fed diet supplemented with BL21(DE3) bacteria as for the RNAseIII-deficient strain, AB301-105(DE3) (FIGS. 6*b*-LD & 7*b*-LD). However, the number of survivors for the five clones were higher for BL21(DE3) than for AB301-105(DE3); at day 12, average mortality values were approximately 25% lower for this strain compared to the RNase III deficient strain. Also, the average weights of survivors fed on diet containing BL21 (DE3) expressing dsRNA corresponding to target LD010 was severely reduced (Table 10-LD, FIG. 8b-LD).

The delay in growth and development of the CPB larvae fed on diet containing either of the two bacterial strains harboring plasmid pGBNJ003 was directly correlated to feeding inhibition since no frass was visible in the wells of refreshed plates from day 4 onwards when compared to bacteria harboring the empty vector pGN29 or the diet only plate. This observation was similar to that where CPB was fed on in vitro transcribed double-stranded RNA topically applied to artificial diet (see Example 3D); here, cessation of feeding occurred from day 2 onwards on treated diet.

Plant-Based Bioassays

Whole potato plants were sprayed with suspensions of chemically induced bacteria expressing dsRNA prior to feeding the plants to CPB larvae. The potato plants of variety "line V" (Wageningen University) were grown from tubers to the 8-12 unfolded leaf stage in a plant growth room chamber with the following conditions: 25±2° C., 60% relative humidity, 16:8 hour light:dark photoperiod. The plants were caged by placing a 500 ml plastic bottle upside down over the plant with the neck of the bottle firmly placed in the soil in a pot and the base cut open and covered with a fine nylon mesh to permit aeration, reduce condensation inside and prevent larval escape. Fifteen Colorado potato beetle larvae at the L1 stage were placed on each treated plant in the cage. Plants were treated with a suspension of E. coli AB301-105(DE3) harboring the pGBNJ003 plasmids (clone 1; FIG. 7a-LD) or pGN29 plasmid (clone 1; see FIG. 7a-LD). Different quantities of bacteria were applied to the plants: 66, 22, and 7 units, where one unit is defined as $10^9$ bacterial cells in 1 ml of a bacterial suspension at optical density value of 1 at 600 nm wavelength. In each case, a total volume of 1.6 ml was sprayed on the plant with the aid of a vaporizer. One plant was used per treatment in this trial. The number of survivors were counted and the weight of each survivor recorded.

Spraying plants with a suspension of E. coli bacterial strain AB301-105(DE3) expressing target dsRNA from pGBNJ003 led to a dramatic increase in insect mortality when compared to pGN29 control. The mortality count was maintained when the amount of bacteria cell suspension was diluted 9-fold (FIG. 9-LD). The average weights of the larval survivors at day 11 on plants sprayed with bacteria harboring the pGBNJ003 vector were approximately 10-fold less than that of pGN29 (FIG. 10-LD). Feeding damage by CPB larvae of the potato plant sprayed with bacteria containing the pGBNJ003 plasmid was much reduced when compared to the damage incurred on a potato plant sprayed with bacteria containing the empty vector pGN29 (FIG. 11-LD).

These experiments showed that double-stranded RNA corresponding to an insect gene target sequence produced in either wild-type or RNaseIII-deficient bacterial expression systems is toxic towards the insect in terms of substantial increases in insect mortality and growth/development delay for larval survivors. It is also clear from these experiments that an exemplification was provided for the effective protection of plants/crops from insect damage by the use of a spray of a formulation consisting of bacteria expressing double-stranded RNA corresponding to an insect gene target.

J. Testing Various Culture Suspension Densities of *Escherichia coli* Expressing dsRNA Target LD010 Against *Leptinotarsa decemlineata*

Preparation and treatment of bacterial cultures are described in Example 3J. Three-fold serial dilutions of cultures (starting from 0.25 unit equivalents) of *Escherichia coli* RNAseIII-deficient strain AB301-105(DE3) expressing double-stranded RNA of target LD010 were applied to foliages of the potato plant of variety 'Bintje' at the 8-12 unfolded leaf stage. Ten L1 larvae of the *L. decemlineata* were placed on the treated plants with one plant per treatment. Scoring for insect mortality and growth impediment was done on day 7 (i.e., 7 days post infestation).

As shown in FIG. 14-LD, high CPB larval mortality (90 to 100%) was recorded after 1 week when insects were fed potato plants treated with a topical application by fine spray of heat-inactivated cultures of *E. coli* harboring plasmid pGBNJ003 (for target 10 dsRNA expression) at densities 0.25, 0.08 and 0.025 bacterial units. At 0.008 units, about a third of the insects were dead, however, the surviving insects were significantly smaller than those in the control groups (*E. coli* harboring the empty vector pGN29 and water only). Feeding damage by CPB larvae of the potato plant sprayed with bacteria containing the pGBNJ003 plasmid at concentrations 0.025 or 0.008 units was much reduced when compared to the damage incurred on a potato plant sprayed with bacteria containing the empty vector pGN29 (FIG. 15-LD).

K. Adults are Extremely Susceptible to Orally Ingested dsRNA Corresponding to Target Genes The example provided below highlights the finding that adult insects (and not only insects of the larval stage) are extremely susceptible to orally ingested dsRNA corresponding to target genes.

Four targets were chosen for this experiment: targets 2, 10, 14 and 16 (SEQ ID NO 168, 188, 198 and 220, respectively). GFP fragment dsRNA (SEQ ID NO 235) was used as a control. Young adults (2 to 3 days old) were picked at random from our laboratory-reared culture with no bias towards insect gender. Ten adults were chosen per treatment. The adults were prestarved for at least 6 hours before the onset of the treatment. On the first day of treatment, each adult was fed four potato leaf discs (diameter 1.5 $cm^2$) which were pretreated with a topical application of 25 µl of 0.1 µg/µl target dsRNA (synthesized as described in Example 3A; topical application as described in Example 3E) per disc. Each adult was confined to a small petri dish (diameter 3 cm) in order to make sure that all insects have ingested equal amounts of food and thus received equal doses of dsRNA. The following day, each adult was again fed four treated leaf discs as described above. On the third day, all ten adults per treatment were collected and placed together in a cage consisting of a plastic box (dimensions 30 cm×20 cm×15 cm) with a fine nylon mesh built into the lid to provide good aeration. Inside the box, some moistened filter paper was placed in the base. Some (untreated) potato foliage was placed on top of the paper to maintain the adults during the experiment. From day 5, regular assessments were carried out to count the number of dead, alive (mobile) and moribund insects. For insect moribundity, adults were laid on their backs to check whether they could right themselves within several minutes; an insect was considered moribund only if it was not able to turn onto its front.

Clear specific toxic effects of double-stranded RNA corresponding to different targets towards adults of the Colorado potato beetle, *Leptinotarsa decemlineata*, were demonstrated in this experiment (FIG. 12-LD). Double-stranded RNA corresponding to a gfp fragment showed no toxicity towards CPB adults on the day of the final assessment (day 19). This experiment clearly showed that the survival of CPB adults was severely reduced only after a few days of exposure to dsRNA when delivered orally. For example, for target 10, on day 5, 5 out of 10 adults were moribund (sick and slow moving); on day 6, 4 out of 10 adults were dead with three of the survivors moribund; on day 9 all adults were observed dead.

As a consequence of this experiment, the application of target double-stranded RNAs against insect pests may be broadened to include the two life stages of an insect pest (i.e. larvae and adults) which could cause extensive crop damage, as is the case with the Colorado potato beetle.

L. Foliar Application of Bacterially Produced dsRNA Provides Protection of Potato from CPB Larval Feeding Damage Under Field Conditions Foliar spraying of bacterially produced dsRNA for Colorado potato beetle control was evaluated in two potato field trials in northern United States. The preparation of the products for field trials "LD010" (heat-killed bacteria with expressed target LD010 dsRNA) and "Control" (control: heat-inactivated *E. coli* with expressed TetR fragment) was as follows:

The 1504-bp cDNA fragment of LD010 was subcloned into the SrfI site of pGN49A yielding pGBNJ003 (as described earlier). The negative control vector, pGN29, contains a 307-bp fragment of the tetracycline resistance repressor (TetR) gene as insert.

For preparation of the products for field trials, 5-mL aliquots of an 50-mL overday culture was used to inoculate several 5-L flasks containing 1.25-L LB broth with 50 μg/mL carbenicillin for overnight growth. IPTG was added to induce the T7 promoter to produce dsRNA. The culture densities were adjusted to OD600 nm=1, the induced bacterial cells were grown and harvested and the cell pellets resuspended in sterile Milli-Q water to a density of 40 units per mL, whereby 1 unit is defined as the number of bacterial cells per ml. For the product used in the herein described field trials, the "unit" is empirically determined to be on average about $3 \times 10^9$ cfu per mL (prior to heat inactivation). Twenty-five mL aliquots of this suspension were transferred into 50-mL Falcon tubes. The concentrated *E. coli* cell suspension was then heat-inactivated by placing the tubes at 80° C. for 30 minutes. The heat-inactivated bacterial suspension samples were pooled together to a final volume of 700 mLs (quantity required for one field trial) under sterile conditions in a laminair flow cabin and stored at −80° C. prior to field testing. Absence of viable *E. coli* cells in the inactivated pool was confirmed by independent, standard tests. The sprayed product was mainly an aqueous suspension of heat-killed bacteria without further optimization. Surfactants and/or adjuvants were optionally added.

Field testing of sprayed potato plants was carried out at two locations: Hamburg, Pa. and Jerome, Id. For each trial, a randomized complete block design was used with 4 replicates per treatment. At the Hamburg location, each plot size was 2.0 m×7.6 m. Potatoes of variety Katandin were planted on May 29th. The commercial standard imidacloprid-based insecticide, Admire 2F, was applied as an in-furrow spray at 0.592 liter/acre on June 10th. All foliar treatments were applied only once on July 31st. "LD010" spray was evaluated at 0.1878 (0.1×rate), 1.878 (1.0×rate) and 9.39 (5.0×rate) liter/acre. "Control" treatments were applied at same rates as for "LD010". A 1.0×rate is equivalent to 1 unit (see definition above) per mL. The commercial standard novaluron-based insecticides, Rimon® (0.83 EC), was applied at 0.355 liter/acre. All spray mixes contained the nonionic surfactant Surfix® at 0.125% v/v. Foliar treatments were applied using a backpack sprayer with a flat fan nozzle and 50-cm nozzle spacing with 4 nozzles per row. Operating pressure was 276 kPa and spray volume 130.6 liters per acre. At the Jerome location, each plot size was 3.7 m×9.1 m. Potatoes of the variety Ranger Russet were planted on May 3rd. The commercial standard imidacloprid-based insecticide, Admire Pro, was applied as an in-furrow spray at 0.257 liter/acre at planting. All foliar treatments were applied only once on July 10th. All foliar treatments were used as described for the Hamburg location and at same rates. No surfactant was used. Treatments were applied using a sprayer with a 3.66 m (12 foot) boom on 46-cm nozzle spacing with 2 nozzles per row. Operating pressure was 145 kPa and spray volume 94 liters per acre. For both locations, CPB larval count and percentage plant defoliation were assessed at different dates and data analyzed using analysis of variance (ANOVA) followed by a mean separation test using either the Duncan's New Multiple Range test (P=0.05) or Student-Newman-Keuls test (P=0.1).

The RNAi spray field trial data are represented in Table 12. The values represent densities of CPB larvae count and percent defoliation of "LD010" and "Control" spray-treated potato plants under field conditions (2008) in (a) Hamburg, Pa., and (b) Jerome, Id.

In Hamburg, foliar treatments were applied once to 9-week-old potatoes naturally infested with a high larvae population composed of approx. 60-70% 1st-2nd instars. Four days after application, a significant reduction in larval counts was recorded for the 5× "LD010" rate and the Rimon® (novaluron) insecticide when compared to 5× "Control", and untreated control (Table 12a). Six days after application, the potato foliage in the 1× and 5× "LD010" treatments suffered little or no additional feeding damage comparable to the Rimon® insecticide, whereas minimal or no protection from foliar feeding was observed in the other treatments (Table 6A). The 5× "LD010" and Rimon® standard provided significant control of larval numbers at 6 DAT. In the 1× "LD010", the $3^{rd}$ and $4^{th}$ instar numbers were significantly reduced when compared to untreated control and 1× "Control" (data not shown). Fourteen days after treatment, the 5× "LD010" still provided a significant reduction in larval feeding damage when compared to untreated control and 5× "control" rate (Table 12a). Resistance in CPB to classical pesticides is building up in large potato growing areas (Aalyoking et al., 2008). For example, the CPB population of Hamburg, Pa. has acquired resistance against imidacloprid (Admire 2F) as can be seen in Table 12a. Despite this acquired resistance against classical pesticides these insect were sensitive to the RNAi spray technology.

In the Jerome trial, the foliar spray with the "LD010" and control products was applied on 67-day-old potatoes, when already heavy larval CPB infestations were prevalent on the potato plots. In contrast to the CPB population in Hamburg, the CPB population in Jerome, Id. was very sensitive to the reference pesticide imidacloprid (Admire Pro). A reduction of larval counts was observed as from 6-to-8 DAT, by the 1× and 5× "LD010" rates. It wasn't until the final evaluation interval 20 days after application that the high rate of "LD010" showed significantly fewer CPB larvae present compared to control, all rates of DNC and the 0.1×rate of "LD010". The 1× and 5×rates of "LD010" showed significantly less defoliation than did the untreated control and all rates of "Control" (Table 12b).

Example 4

*Phaedon cochleariae* (Mustard Leaf Beetle)

A. Cloning of a Partial Sequence of the *Phaedon Cochleariae* (Mustard Leaf Beetle) PC001, PC003, PC005, PC010, PC014, PC016 and PC027 Genes Via Family PCR High quality, intact RNA was isolated from the third larval stage of *Phaedon cochleariae* (mustard leaf beetle; source: Dr. Caroline Muller, Julius-von-Sachs-Institute for Biosciences, Chemical Ecology Group, University of Wuerzburg, Julius-von-Sachs-Platz 3, D-97082 Wuerzburg, Germany) using TRIzol Reagent (Cat. Nr. 15596-026/15596-018, Invitrogen, Rockville, Md., USA) following the manufacturer's instructions. Genomic DNA present in the RNA preparation was removed by DNase (Cat. Nr. 1700, Promega) treatment following the manufacturer's instructions. cDNA was generated using a commercially available kit (SuperScript™ III Reverse Transcriptase, Cat. Nr. 18080044, Invitrogen, Rockville, Md., USA) following the manufacturer's instructions.

To isolate cDNA sequences comprising a portion of the PC001, PC003, PC005, PC010, PC014, PC016 and PC027 genes, a series of PCR reactions with degenerate primers were performed using Amplitaq Gold (Cat. Nr. N8080240, Applied Biosystems) following the manafacturer's instructions.

The sequences of the degenerate primers used for amplification of each of the genes are given in Table 2-PC. These primers were used in respective PCR reactions with the following conditions: 10 minutes at 95° C., followed by 40 cycles of 30 seconds at 95° C., 1 minute at 55° C. and 1 minute at 72° C., followed by 10 minutes at 72° C. The resulting PCR fragments were analyzed on agarose gel, purified (QIAquick Gel Extraction kit, Cat. Nr. 28706, Qiagen), cloned into the pCR4/TOPO vector (Cat. Nr. K4530-20, Invitrogen) and sequenced. The sequences of the resulting PCR products are represented by the respective SEQ ID NOs as given in Table 2-PC and are referred to as the partial sequences.

The corresponding partial amino acid sequence are represented by the respective SEQ ID NOs as given in Table 3-PC. Table 3-PC provides amino acid sequences of cDNA clones, and the start of the reading frame is indicated in brackets.

B. dsRNA Production of the *Phaedon cochleariae* Genes dsRNA was synthesized in milligram amounts using the commercially available kit T7 Ribomax™ Express RNAi System (Cat. Nr. P1700, Promega). First two separate single 5' T7 RNA polymerase promoter templates were generated in two separate PCR reactions, each reaction containing the target sequence in a different orientation relative to the T7 promoter.

For each of the target genes, the sense T7 template was generated using specific T7 forward and specific reverse primers. The sequences of the respective primers for amplifying the sense template for each of the target genes are given in Table 8-PC. Table 8-PC provides details for preparing ds RNA fragments of *Phaedon cochleariae* target sequences, including primer sequences.

The conditions in the PCR reactions were as follows: 1 minute at 95° C., followed by 20 cycles of 30 seconds at 95° C., 30 seconds at 60° C. and 1 minute at 72° C., followed by 15 cycles of 30 seconds at 95° C., 30 seconds at 50° C. and 1 minute at 72° C. followed by 10 minutes at 72° C. The anti-sense T7 template was generated using specific forward and specific T7 reverse primers in a PCR reaction with the same conditions as described above. The sequences of the respective primers for amplifying the anti-sense template for each of the target genes are given in Table 8-PC. The resulting PCR products were analyzed on agarose gel and purified by PCR purification kit (Qiaquick PCR Purification Kit, Cat. Nr. 28106, Qiagen) and NaClO$_4$ precipitation. The generated T7 forward and reverse templates were mixed to be transcribed and the resulting RNA strands were annealed, DNase and RNase treated, and purified by sodium acetate, following the manufacturer's instructions. The sense strand of the resulting dsRNA for each of the target genes is given in Table 8-PC.

C. Laboratory Trials of *Myzus periscae* (Green Peach Aphid) Infestation on Transgenic *Arabidopsis thaliana* Plants Generation of Transgenic Plants

*Arabidopsis thaliana* plants were transformed using the floral dip method (Clough and Bent (1998) Plant Journal 16:735-743). Aerial parts of the plants were incubated for a few seconds in a solution containing 5% sucrose, resuspended *Agrobacterium tumefaciens* strain C58C1 Rif cells from an overnight culture and 0.03% of the surfactant Silwet L-77. After inoculation, plants were covered for 16 hours with a transparent plastic to maintain humidity. To increase the transformation efficiency, the procedure was repeated after one week. Watering was stopped as seeds matured and dry seeds were harvested and cold-treated for two days. After sterilization, seeds were plated on a kanamycin-containing growth medium for selection of transformed plants.

The selected plants are transferred to soil for optimal T2 seed production.

Bioassay

Transgenic *Arabidopsis thaliana* plants are selected by allowing the segregating T2 seeds to germinate on appropriate selection medium. When the roots of these transgenics are well-established they are then transferred to fresh artificial growth medium or soil and allowed to grow under optimal conditions. Whole transgenic plants are tested against nymphs of the green peach aphid (*Myzus persicae*) to show (1) a significant resistance to plant damage by the feeding nymph, (2) increased nymphal mortality, and/or (3) decreased weight of nymphal survivors (or any other aberrant insect development).

D. Laboratory Trials to Test dsRNA Targets, Using Oilseed Rape Leaf Discs for Activity Against *Phaedon cochleariae* Larvae The example provided below is an exemplification of the finding that the mustard leaf beetle (MLB) larvae are susceptible to orally ingested dsRNA corresponding to own target genes.

To test the different double-stranded RNA samples against MLB larvae, a leaf disc assay was employed using oilseed rape (*Brassica napus* variety SW Oban; source: Nick Balaam, Sw Seed Ltd., 49 North Road, Abington, Cambridge, CB1 6AS, UK) leaf material as food source. The insect cultures were maintained on the same variety of oilseed rape in the insect chamber at 25±2° C. and 60±5% relative humidity with a photoperiod of 16 h light/8 h dark. Discs of approximately 1.1 cm in diameter (or 0.95 cm$^2$) were cut out off leaves of 4- to 6-week old rape plants using a suitably-sized cork borer. Double-stranded RNA samples were diluted to 0.1 µg/µl in Milli-Q water containing 0.05% Triton X-100. Treated leaf discs were prepared by applying 25 µl of the diluted solution of target PC001, PC003, PC005, PC010, PC014, PC016, PC027 dsRNA and control gfp dsRNA or 0.05% Triton X-100 on the adaxial leaf surface. The leaf discs were left to dry and placed individually in each of the 24 wells of a 24-well multiplate containing 1 ml of gellified 2% agar which helps to prevent the leaf disc from drying out. Two neonate MLB larvae were placed into each well of the plate, which was then covered with a multiwell plastic lid. The plate (one treatment containing 48 insects) was divided into 4 replicates of 12 insects per replicate (each row). The plate containing the insects and leaf discs were kept in an insect chamber at 25±2° C. and 60±5% relative humidity with a photoperiod of 16 h light/8 h dark. The insects were fed leaf discs for 2 days after which they were transferred to a new plate containing freshly treated leaf discs. Thereafter, 4 days after the start of the bioassay, the insects from each replicate were collected and transferred to a Petri dish containing untreated fresh oilseed rape leaves. Larval mortality and average weight were recorded at days 2, 4 7, 9 and 11.

*P. cochleariae* larvae fed on intact naked target dsRNA-treated oilseed rape leaves resulted in significant increases in larval mortalities for all targets tested, as indicated in FIG. 1(*a*). Tested double-stranded RNA for target PC010 led to 100% larval mortality at day 9 and for target PC027 at day 11. For all other targets, significantly high mortality values were reached at day 11 when compared to control gfp dsRNA, 0.05% Triton X-100 alone or untreated leaf only: (average value in percentage±confidence interval with alpha 0.05) PC001 (94.4±8.2); PC003 (86.1±4.1); PC005 (83.3±7.8); PC014 (63.9±20.6); PC016 (75.0±16.8); gfp dsRNA (11.1±8.2); 0.05% Triton X-100 (19.4±10.5); leaf only (8.3±10.5).

Larval survivors were assessed based on their average weight. For all targets tested, the mustard leaf beetle larvae had significantly reduced average weights after day 4 of the bioassay; insects fed control gfp dsRNA or 0.05% Triton X-100 alone developed normally, as for the larvae on leaf only (FIG. 1(*b*)-PC).

E. Laboratory Trials to Screen dsRNAs at Different Concentrations Using Oilseed Rape Leaf Discs for Activity Against *Phaedon Cochleariae* Larvae Twenty-five µl of a solution of dsRNA from target PC010 or PC027 at serial ten-fold concentrations from 0.1 µg/µl down to 0.1 ng/µl was applied topically onto the oilseed rape leaf disc, as described in Example 4D above. As a negative control, 0.05% Triton X-100 only was administered to the leaf disc. Per treatment, twenty-four mustard leaf beetle neonate larvae, with two insects per well, were tested. The plates were stored in the insect rearing chamber at 25±2° C., 60±5% relative humidity, with a 16:8 hours light:dark photoperiod. At day 2, the larvae were transferred on to a new plate containing fresh dsRNA-treated leaf discs. At day 4 for target PC010 and day 5 for target PC027, insects from each replicate were transferred to a Petri dish containing abundant untreated leaf material. The beetles were assessed as live or dead on days 2, 4, 7, 8, 9, and 11 for target PC010, and 2, 5, 8, 9 and 12 for target PC027.

Feeding oilseed rape leaf discs containing intact naked dsRNAs of the two different targets, PC010 and PC027, to *P. cochleariae* larvae resulted in high mortalities at concentrations down to as low as 1 ng dsRNA/µl solution, as shown in FIGS. 2 (*a*) and (*b*). Average mortality values in percentage±confidence interval with alpha 0.05 for different concentrations of dsRNA for target PC010 at day 11, 0 µg/µl: 8.3±9.4; 0.1 µg/µl: 100; 0.01 µg/µl: 79.2±20.6; 0.001 µg/µl: 58.3±9.4; 0.0001 µg/µl: 12.5±15.6; and for target PC027 at day 12, 0 µg/µl: 8.3±9.4; 0.1 µg/µl: 95.8±8.2; 0.01 µg/µl: 95.8±8.2; 0.001 µg/µl: 83.3±13.3; 0.0001 µg/µl: 12.5±8.2.

F. Cloning of a MLB Gene Fragment in a Vector Suitable for Bacterial Production of Insect-Active Double-Stranded RNA What follows is an example of cloning a DNA fragment corresponding to an MLB gene target in a vector for the expression of double-stranded RNA in a bacterial host, although any vector comprising a T7 promoter or any other promoter for efficient transcription in bacteria, may be used (reference to WO0001846).

The sequences of the specific primers used for the amplification of target gene fragment PC010 are provided in Table 8-PC. The template used was the pCR8/GW/topo vector containing the PC010 sequence (SEQ ID NO 253). The primers were used in a touch-down PCR reaction with the following conditions: 1 minute at 95° C., followed by 20 cycles of 30 seconds at 95° C., 30 seconds at 60° C. with temperature decrease of −0.5° C. per cycle and 1 minute at 72° C., followed by 15 cycles of 30 seconds at 95° C., 30 seconds at 50° C. and 1 minute at 72° C., followed by 10 minutes at 72° C. The resulting PCR fragment was analyzed on agarose gel, purified (QIAquick Gel Extraction kit, Cat. Nr. 28706, Qiagen), blunt-end cloned into Srf I-linearized pGNA49A vector (reference to WO00188121A1), and sequenced. The sequence of the resulting PCR product corresponds to SEQ ID NO 488 as given in Table 8-PC. The recombinant vector harboring this sequence was named pGCDJ001.

G. Expression and Production of a Double-Stranded RNA Target in One Strain of *Escherichia coli* AB301-105(DE3)

The procedures described below are followed in order to express suitable levels of insect-active double-stranded RNA of insect target in bacteria. In this experiment, an RNaseIII-deficient strain, AB301-105(DE3) was used.

Transformation of AB301-105(DE3)

Three hundred ng of the plasmid were added to and gently mixed in a 50 µl aliquot of ice-chilled chemically competent *E. coli* strain AB301-105(DE3). The cells were incubated on ice for 20 minutes before subjecting them to a heat shock treatment of 37° C. for 5 minutes, after which the cells were placed back on ice for a further 5 minutes. Four hundred and fifty µl of room temperature SOC medium was added to the cells and the suspension incubated on a shaker (250 rpm) at 37° C. for 1 hour. One hundred µl of the bacterial cell suspension was transferred to a 500 ml conical flask containing 150 ml of liquid Luria-Bertani (LB) broth supplemented with 100 µg/ml carbenicillin antibiotic. The culture was incubated on an Innova 4430 shaker (250 rpm) at 37° C. overnight (16 to 18 hours).

Chemical Induction of Double-Stranded RNA Expression in AB301-105(DE3)

Expression of double-stranded RNA from the recombinant vector, pGXXX0XX, in the bacterial strain AB301-105 (DE3) was made possible since all the genetic components for controlled expression are present. In the presence of the chemical inducer isopropylthiogalactoside, or IPTG, the T7 polymerase will drive the transcription of the target sequence in both antisense and sense directions since these are flanked by oppositely oriented T7 promoters.

The optical density at 600 nm of the overnight bacterial culture was measured using an appropriate spectrophotometer and adjusted to a value of 1 bp the addition of fresh LB broth. Fifty ml of this culture was transferred to a 50 ml Falcon tube and the culture then centrifuged at 3000 g at 15° C. for 10 minutes. The supernatant was removed and the bacterial pellet resuspended in 50 ml of fresh S complete medium (SNC medium plus 5 µg/ml cholesterol) supplemented with 100 µg/ml carbenicillin and 1 mM IPTG. The bacteria were induced for 2 to 4 hours at room temperature.

Heat Treatment of Bacteria

Bacteria were killed by heat treatment in order to minimize the risk of contamination of the artificial diet in the test plates. However, heat treatment of bacteria expressing double-stranded RNA is not a prerequisite for inducing toxicity towards the insects due to RNA interference. The induced bacterial culture was centrifuged at 3000 g at room temperature for 10 minutes, the supernatant discarded and the pellet subjected to 80° C. for 20 minutes in a water bath. After heat treatment, the bacterial pellet was resuspended in a total volume of 50 ml of 0.05% Triton X-100 solution. The tube was stored at 4° C. until further use H. Laboratory Trials to Test *Escherichia coli* Expressing dsRNA Target Against *Phaedon cochleariae*

Leaf Disc Bioassays

The leaf-disc bioassay method was employed to test double-stranded RNA from target PC010 produced in *Escherichia coli* (from plasmid pGCDJ001) against larvae of the mustard leaf beetle. Leaf discs were prepared from oilseed rape foliage, as described in Example 4. Twenty it of a bacterial suspension, with an optical density measurement of 1 at 600 nm wavelength, was pipetted onto each disc. The leaf disc was placed in a well of a 24-multiwell plate containing 1 ml gellified agar. On each leaf disc were added two neonate larvae. For each treatment, 3 replicates of 16 neonate larvae per replicate were prepared. The plates were kept in the insect rearing chamber at 25±2° C. and 60±5% relative humidity, with a 16:8 hours light:dark photoperiod. At day 3 (i.e. 3 days post start of bioassay), larvae were transferred to a new plate containing fresh treated (same dosage) leaf discs. The leaf material was refreshed every other day from day 5 onwards. The bioassay was scored on mortality and average weight. Negative controls were leaf discs treated with bacteria harboring plasmid pGN29 (empty vector) and leaf only.

A clear increase in mortality of *P. cochleariae* larvae with time was shown after the insects were fed on oilseed rape leaves treated with a suspension of RNaseIII-deficient *E. coli* strain AB301-105(DE3) containing plasmid pGCDJ001, whereas very little or no insect mortality was observed in the case of bacteria with plasmid pGN29 or leaf only control (FIG. 3-PC).

Plant-Based Bioassays

Whole plants are sprayed with suspensions of heat-inactivated chemically induced bacteria expressing dsRNA prior to feeding the plants to MLB. The are grown from in a plant growth room chamber. The plants are caged by placing a 500 ml plastic bottle upside down over the plant with the neck of the bottle firmly placed in the soil in a pot and the base cut open and covered with a fine nylon mesh to permit aeration, reduce condensation inside and prevent insect escape. MLB are placed on each treated plant in the cage. Plants are treated with a suspension of *E. coli* AB301-105(DE3) harboring the pGCDJ001 plasmids or pGN29 plasmid. Different quantities of bacteria are applied to the plants: for instance 66, 22, and 7 units, where one unit is defined as $10^9$ bacterial cells in 1 ml of a bacterial suspension at optical density value of 1 at 600 nm wavelength. In each case, a total volume of between 1 and 10 ml s sprayed on the plant with the aid of a vaporizer. One plant is used per treatment in this trial. The number of survivors are counted and the weight of each survivor recorded.

Spraying plants with a suspension of *E. coli* bacterial strain AB301-105(DE3) expressing target dsRNA from pGCDJ001 leads to a dramatic increase in insect mortality when compared to pGN29 control. These experiments show that double-stranded RNA corresponding to an insect gene target sequence produced in either wild-type or RNaseIII-deficient bacterial expression systems is toxic towards the insect in terms of substantial increases in insect mortality and growth/development delay for larval survivors. It is also clear from these experiments that an exemplification is provided for the effective protection of plants/crops from insect damage by the use of a spray of a formulation consisting of bacteria expressing double-stranded RNA corresponding to an insect gene target.

I. RNAi-by-Feeding Technology is Highly Selective. Design of Concatemers of RNAi Target Gene Fragments to Fine-Tune Specificity and Selectivity.

To study the selectivity of the RNA interference technology against targeted pests, the Colorado potato beetle target fragment of LD010 dsRNA was tested against its corresponding counterpart of the mustard leaf beetle, *Phaedon cochleariae*, also a chrysomelid beetle, PC010 dsRNA against CPB in feeding bioassays (FIG. 4-PC). DNA concatemers used in this study were manufactured at Eurogentec and subcloned into the PstI and BamHI sites of pGN9 vector for bacterial expression. The 300-bp LD010 and PC010 moieties of the concatemers were designed from the respective target cDNAs (described earlier): the sequences of the moieties correspond to the sequence at position 318-617 bp of the 1504-bp LD010 (SEQ ID NO 11) and positions 312-611 bp of the 1498-bp PC010 (SEQ ID NO 253), respectively. The 300-bp gfp moiety corresponds to the egfp sequence (Clontech).

FIG. 4-PC (A) shows the DNA nucleotide sequence comparison between LD010 (CPB-specific) and PC010 (MLB-specific) gene fragment dsRNAs, SEQ ID NO 2487 and SEQ ID NO 2488, respectively. Identical nucleotide sequences (75%) are indicated in gray shading. Concatemers were constructed consisting of combinations of CPB, MLB target gene 010 orthologues and control (gfp) fragments. FIG. 4-PC (B) shows a schematic overview of the RNA concatemers where A and B represent cpb or gfp, and mlb or gfp, moieties, respectively. Effects of target gene 010 orthologues on survival of larvae of the CPB (FIG. 4-PC(C)) or MLB (FIG. 4-PC(D)) were tested in feeding bioassays. Bioassays with Colorado potato beetle were performed using artificial diet (as described earlier). Twenty-five μL of the test solution was topically applied to the diet. One L2 Colorado potato beetle larva was placed onto the treated diet with a fine paintbrush. The lids were placed firmly onto the plates. Twenty-four to forty-eight larvae were tested per treatment. Bioassays with MLB larvae were performed using oilseed rape leaf discs. Discs of 1 cm diameter were excised from oilseed rape leaves, painted on one surface with 25-μL test sample and allowed to dry before adding the insects. Each leaf disc was placed onto 1-mL gellified agarose in a well of a 24-well plate to prevent drying out of the disc during the bioassay. One L2 larva was placed with a fine brush onto the treated leaf disc. The plates were sealed with lids and incubated in the rearing chambers. After five days, all leaf discs were replaced by fresh, untreated leaf discs and thereafter when required. Thirty-six larvae were tested per treatment. Mortality and/or weight assessments were conducted at regular intervals throughout the duration of the bioassays. Data were analyzed using GraphPad Prism 4 software.

In an artificial diet-based CPB bioassay, insect survival was reduced by approximately 90% over time when larvae were fed heat-killed bacterially produced LD010-300 bp-containing dsRNA concatemers (cpb-gfp and cpb-mlb), whereas no increase in mortality was observed with the PC010 (300 bp) single concatemers and the controls: PC010 (gfp-mlb) and GFP (gfp-gfp) dsRNAs (FIG. 4-PC(C)). Likewise, RNAi-induced lethality was only demonstrated when bacterially produced PC010-300 bp-containing dsRNA concatemers (gfp-mlb and cpb-mlb) were fed to MLB larvae using treated oilseed rape leaf discs (FIG. 4-PC(D)); no significant differences in MLB mortality were observed for the cpb-gfp and gfp-gfp dsRNAs. These results clearly illustrate that this technology is highly selective towards the targeted pests.

Example 5

*Epilachna varivetis* (Mexican Bean Beetle)

A. Cloning *Epilachna varivetis* Partial Gene Sequences

High quality, intact RNA was isolated from 4 different larval stages of *Epilachna varivetis* (Mexican bean beetle;

source: Thomas Dorsey, Supervising Entomologist, New Jersey Department of Agriculture, Division of Plant Industry, Bureau of Biological Pest Control, Phillip Alampi Beneficial Insect Laboratory, PO Box 330, Trenton, N.J. 08625-0330, USA) using TRIzol Reagent (Cat. Nr. 15596-026/15596-018, Invitrogen, Rockville, Md., USA) following the manufacturer's instructions. Genomic DNA present in the RNA preparation was removed by DNase treatment following the manafacturer's instructions (Cat. Nr. 1700, Promega). cDNA was generated using a commercially available kit (Super-Script™ III Reverse Transcriptase, Cat. Nr. 18080044, Invitrogen, Rockville, Md., USA) following the manufacturer's instructions.

To isolate cDNA sequences comprising a portion of the EV005, EV009, EV010, EV015 and EV016 genes, a series of PCR reactions with degenerate primers were performed using Amplitaq Gold (Cat. Nr. N8080240, Applied Biosystems) following the manufacturer's instructions.

The sequences of the degenerate primers used for amplification of each of the genes are given in Table 2-EV, which displays *Epilachna varivetis* target genes including primer sequences and cDNA sequences obtained. These primers were used in respective PCR reactions with the following conditions: for EV005 and EV009, 10 minutes at 95° C., followed by 40 cycles of 30 seconds at 95° C., 1 minute at 50° C. and 1 minute 30 seconds at 72° C., followed by 7 minutes at 72° C.; for EV014, 10 minutes at 95° C., followed by 40 cycles of 30 seconds at 95° C., 1 minute at 53° C. and 1 minute at 72° C., followed by 7 minutes at 72° C.; for EV010 and EV016, 10 minutes at 95° C., followed by 40 cycles of 30 seconds at 95° C., 1 minute at 54° C. and 1 minute 40 seconds at 72° C., followed by 7 minutes at 72° C. The resulting PCR fragments were analyzed on agarose gel, purified (QIAquick Gel Extraction kit, Cat. Nr. 28706, Qiagen), cloned into the pCR4/TOPO vector (Cat. Nr. K4530-20, Invitrogen), and sequenced. The sequences of the resulting PCR products are represented by the respective SEQ ID NOs as given in Table 2-EV and are referred to as the partial sequences. The corresponding partial amino acid sequences are represented by the respective SEQ ID NOs as given in Table 3-EV, where the start of the reading frame is indicated in brackets.

B. dsRNA Production of the *Epilachna varivetis* Genes dsRNA was synthesized in milligram amounts using the commercially available kit T7 Ribomax™ Express RNAi System (Cat. Nr. P1700, Promega). First two separate single 5' T7 RNA polymerase promoter templates were generated in two separate PCR reactions, each reaction containing the target sequence in a different orientation relative to the T7 promoter.

For each of the target genes, the sense T7 template was generated using specific T7 forward and specific reverse primers. The sequences of the respective primers for amplifying the sense template for each of the target genes are given in Table 8-EV.

The conditions in the PCR reactions were as follows: 1 minute at 95° C., followed by 20 cycles of 30 seconds at 95° C., 30 seconds at 60° C. and 1 minute at 72° C., followed by 15 cycles of 30 seconds at 95° C., 30 seconds at 50° C. and 1 minute at 72° C. followed by 10 minutes at 72° C. The anti-sense T7 template was generated using specific forward and specific T7 reverse primers in a PCR reaction with the same conditions as described above. The sequences of the respective primers for amplifying the anti-sense template for each of the target genes are given in Table 8-EV. The resulting PCR products were analyzed on agarose gel and purified by PCR purification kit (Qiaquick PCR Purification Kit, Cat. Nr. 28106, Qiagen) and $NaClO_4$ precipitation. The generated T7 forward and reverse templates were mixed to be transcribed and the resulting RNA strands were annealed, DNase and RNase treated, and purified by sodium acetate, following the manufacturer's instructions. The sense strand of the resulting dsRNA for each of the target genes is given in Table 8-EV.

C. Laboratory Trials to Test dsRNA Targets Using Bean Leaf Discs for Activity Against *Epilachna varivetis* Larvae The example provided below is an exemplification of the finding that the Mexican bean beetle (MBB) larvae are susceptible to orally ingested dsRNA corresponding to own target genes.

To test the different double-stranded RNA samples against MBB larvae, a leaf disc assay was employed using snap bean (*Phaseolus vulgaris* variety Montano; source: Aveve N V, Belgium) leaf material as food source. The same variety of beans was used to maintain insect cultures in the insect chamber at 25±2° C. and 60±5% relative humidity with a photoperiod of 16 h light/8 h dark. Discs of approximately 1.1 cm in diameter (or 0.95 $cm^2$) were cut out off leaves of 1- to 2-week old bean plants using a suitably-sized cork borer. Double-stranded RNA samples were diluted to 1 μg/μl in Milli-Q water containing 0.05% Triton X-100. Treated leaf discs were prepared by applying 25 μl of the diluted solution of target Ev005, Ev010, Ev015, Ev016 dsRNA and control gfp dsRNA or 0.05% Triton X-100 on the adaxial leaf surface. The leaf discs were left to dry and placed individually in each of the 24 wells of a 24-well multiplate containing 1 ml of gellified 2% agar which helps to prevent the leaf disc from drying out. A single neonate MBB larva was placed into each well of a plate, which was then covered with a multiwell plastic lid. The plate was divided into 3 replicates of 8 insects per replicate (row). The plate containing the insects and leaf discs were kept in an insect chamber at 25±2° C. and 60±5% relative humidity with a photoperiod of 16 h light/8 h dark. The insects were fed on the leaf discs for 2 days after which the insects were transferred to a new plate containing freshly treated leaf discs. Thereafter, 4 days after the start of the bioassay, the insects were transferred to a petriplate containing untreated fresh bean leaves every day until day 10. Insect mortality was recorded at day 2 and every other day thereafter.

Feeding snap bean leaves containing surface-applied intact naked target dsRNAs to *E. varivestis* larvae resulted in significant increases in larval mortalities, as indicated in FIG. 1. Tested double-stranded RNAs of targets Ev010, Ev015, & Ev016 led to 100% mortality after 8 days, whereas dsRNA of target Ev005 took 10 days to kill all larvae. The majority of the insects fed on treated leaf discs containing control gfp dsRNA or only the surfactant Triton X-100 were sustained throughout the bioassay (FIG. 1-EV).

D. Laboratory Trials to Test dsRNA Targets Using Bean Leaf Discs for Activity Against *Epilachna varivestis* Adults The example provided below is an exemplification of the finding that the Mexican bean beetle adults are susceptible to orally ingested dsRNA corresponding to own target genes.

In a similar bioassay set-up as for Mexican bean beetle larvae, adult MBBs were tested against double-stranded RNAs topically-applied to bean leaf discs. Test dsRNA from each target Ev010, Ev015 and Ev016 was diluted in 0.05% Triton X-100 to a final concentration of 0.1 μg/μl. Bean leaf discs were treated by topical application of 30 μl of the test solution onto each disc. The discs were allowed to dry completely before placing each on a slice of gellified 2% agar in each well of a 24-well multiwell plate. Three-day-old adults were collected from the culture cages and fed nothing for 7-8 hours prior to placing one adult to each well of the bioassay plate (thus 24 adults per treatment). The plates were kept in the insect rearing chamber (under the same conditions as for MBB larvae for 24 hours) after which the adults were transferred to a new plate containing fresh dsRNA-treated leaf discs. After a further 24 hours, the adults from each treatment were collected and placed in a plastic box with dimensions 30 cm×15 cm×10 cm containing two potted and untreated 3-week-old bean plants. Insect mortality was assessed from day 4 until day 11.

All three target dsRNAs (Ev010, Ev015 and Ev016) ingested by adults of *Epilachna varivestis* resulted in significant increases in mortality from day 4 (4 days post bioassay start), as shown in FIG. 2(*a*)-EV. From day 5, dramatic changes in feeding patterns were observed between insects fed initially with target-dsRNA-treated bean leaf discs and those that were fed discs containing control gfp dsRNA or surfactant Triton X-100. Reductions in foliar damage by MBB adults of untreated bean plants were clearly visible for all three targets when compared to gfp dsRNA and surfactant only controls, albeit at varying levels; insects fed target 15 caused the least damage to bean foliage (FIG. 2(*b*)-EV).

E. Cloning of a MBB Gene Fragment in a Vector Suitable for Bacterial Production of Insect-Active Double-Stranded RNA What follows is an example of cloning a DNA fragment corresponding to an MBB gene target in a vector for the expression of double-stranded RNA in a bacterial host, although any vector comprising a T7 promoter or any other promoter for efficient transcription in bacteria, may be used (reference to WO0001846).

The sequences of the specific primers used for the amplification of target genes are provided in Table 8-EV. The template used is the pCR8/GW/topo vector containing any of target sequences. The primers are used in a PCR reaction with the following conditions: 5 minutes at 98° C., followed by 30 cycles of 10 seconds at 98° C., 30 seconds at 55° C. and 2 minutes at 72° C., followed by 10 minutes at 72° C. The resulting PCR fragment is analyzed on agarose gel, purified (QIAquick Gel Extraction kit, Cat. Nr. 28706, Qiagen), blunt-end cloned into Srf I-linearized pGNA49A vector (reference to WO00188121A1), and sequenced. The sequence of the resulting PCR product corresponds to the respective sequence as given in Table 8-EV. The recombinant vector harboring this sequence is named pGXXX0XX.

F. Expression and Production of a Double-Stranded RNA Target in Two Strains of *Escherichia coli*: (1) AB301-105 (DE3), and, (2) BL21(DE3)

The procedures described below are followed in order to express suitable levels of insect-active double-stranded RNA of insect target in bacteria. An RNaseIII-deficient strain, AB301-105(DE3), is used in comparison to wild-type RNaseIII-containing bacteria, BL21(DE3).

Transformation of AB301-105(DE3) and BL21(DE3)

Three hundred ng of the plasmid are added to and gently mixed in a 50 µl aliquot of ice-chilled chemically competent *E. coli* strain AB301-105(DE3) or BL21(DE3). The cells are incubated on ice for 20 minutes before subjecting them to a heat shock treatment of 37° C. for 5 minutes, after which the cells are placed back on ice for a further 5 minutes. Four hundred and fifty µl of room temperature SOC medium is added to the cells and the suspension incubated on a shaker (250 rpm) at 37° C. for 1 hour. One hundred µl of the bacterial cell suspension is transferred to a 500 ml conical flask containing 150 ml of liquid Luria-Bertani (LB) broth supplemented with 100 µg/ml carbenicillin antibiotic. The culture is incubated on an Innova 4430 shaker (250 rpm) at 37° C. overnight (16 to 18 hours).

Chemical Induction of Double-Stranded RNA Expression in AB301-105(DE3) and BL21(DE3)

Expression of double-stranded RNA from the recombinant vector, pGXXX0XX, in the bacterial strain AB301-105 (DE3) or BL21(DE3) is made possible since all the genetic components for controlled expression are present. In the presence of the chemical inducer isopropylthiogalactoside, or IPTG, the T7 polymerase will drive the transcription of the target sequence in both antisense and sense directions since these are flanked by oppositely oriented T7 promoters.

The optical density at 600 nm of the overnight bacterial culture is measured using an appropriate spectrophotometer and adjusted to a value of 1 by the addition of fresh LB broth. Fifty ml of this culture is transferred to a 50 ml Falcon tube and the culture then centrifuged at 3000 g at 15° C. for 10 minutes. The supernatant is removed and the bacterial pellet resuspended in 50 ml of fresh S complete medium (SNC medium plus 5 µg/ml cholesterol) supplemented with 100 µg/ml carbenicillin and 1 mM IPTG. The bacteria are induced for 2 to 4 hours at room temperature.

Heat Treatment of Bacteria

Bacteria are killed by heat treatment in order to minimize the risk of contamination of the artificial diet in the test plates. However, heat treatment of bacteria expressing double-stranded RNA is not a prerequisite for inducing toxicity towards the insects due to RNA interference. The induced bacterial culture is centrifuged at 3000 g at room temperature for 10 minutes, the supernatant discarded and the pellet subjected to 80° C. for 20 minutes in a water bath. After heat treatment, the bacterial pellet is resuspended in 1.5 ml MilliQ water and the suspension transferred to a microfuge tube. Several tubes are prepared and used in the bioassays for each refreshment. The tubes are stored at −20° C. until further use.

G. Laboratory Trials to Test *Escherichia coli* Expressing dsRNA Targets Against *Epilachna varivetis*

Plant-Based Bioassays

Whole plants are sprayed with suspensions of chemically induced bacteria expressing dsRNA prior to feeding the plants to MBB. The are grown from in a plant growth room chamber. The plants are caged by placing a 500 ml plastic bottle upside down over the plant with the neck of the bottle firmly placed in the soil in a pot and the base cut open and covered with a fine nylon mesh to permit aeration, reduce condensation inside and prevent insect escape. MMB are placed on each treated plant in the cage. Plants are treated with a suspension of *E. coli* AB301-105(DE3) harboring the pGBNJ001 plasmids or pGN29 plasmid. Different quantities of bacteria are applied to the plants: for instance 66, 22, and 7 units, where one unit is defined as $10^9$ bacterial cells in 1 ml of a bacterial suspension at optical density value of 1 at 600 nm wavelength. In each case, a total volume of between 1 and 10 ml s sprayed on the plant with the aid of a vaporizer. One plant is used per treatment in this trial. The number of survivors are counted and the weight of each survivor recorded.

Spraying plants with a suspension of *E. coli* bacterial strain AB301-105(DE3) expressing target dsRNA from pGXXX0XX lead to a dramatic increase in insect mortality when compared to pGN29 control. These experiments show that double-stranded RNA corresponding to an insect gene target sequence produced in either wild-type or RNaseIII-deficient bacterial expression systems is toxic towards the insect in terms of substantial increases in insect mortality and growth/development delay for larval survivors. It is also clear from these experiments that an exemplification is provided for the effective protection of plants/crops from insect damage by the use of a spray of a formulation consisting of bacteria expressing double-stranded RNA corresponding to an insect gene target.

Example 6

*Anthonomus grandis* (Cotton Boll Weevil)

A. Cloning *Anthonomus grandis* Partial Sequences

High quality, intact RNA was isolated from the 3 instars of *Anthonomus grandis* (cotton boll weevil; source: Dr. Gary Benzon, Benzon Research Inc., 7 Kuhn Drive, Carlisle, Pa. 17013, USA) using TRIzol Reagent (Cat. Nr. 15596-026/15596-018, Invitrogen, Rockville, Md., USA) following the manufacturer's instructions. Genomic DNA present in the RNA preparation was removed by DNase treatment following the manafacturer's instructions (Cat. Nr. 1700, Promega). cDNA was generated using a commercially available kit (SuperScript™ III Reverse Transcriptase, Cat. Nr. 18080044, Invitrogen, Rockville, Md., USA) following the manufacturer's instructions.

To isolate cDNA sequences comprising a portion of the AG001, AG005, AG010, AG014 and AG016 genes, a series of PCR reactions with degenerate primers were performed using Amplitaq Gold (Cat. Nr. N8080240, Applied Biosystems) following the manufacturer's instructions.

The sequences of the degenerate primers used for amplification of each of the genes are given in Table 2-AG. These primers were used in respective PCR reactions with the following conditions: for AG001, AG005 and AG016, 10 minutes at 95° C., followed by 40 cycles of 30 seconds at 95° C., 1 minute at 50° C. and 1 minute and 30 seconds at 72° C., followed by 7 minutes at 72° C.; for AG010, 10 minutes at 95° C., followed by 40 cycles of 30 seconds at 95° C., 1 minute at 54° C. and 2 minutes and 30 seconds at 72° C., followed by 7 minutes at 72° C.; for AG014, 10 minutes at 95° C., followed by 40 cycles of 30 seconds at 95° C., 1 minute at 55° C. and 1 minute at 72° C., followed by 7 minutes at 72° C. The resulting PCR fragments were analyzed on agarose gel, purified (QIAquick Gel Extraction kit, Cat. Nr. 28706, Qiagen), cloned into the pCR8/GW/TOPO vector (Cat. Nr. K2500-20, Invitrogen) and sequenced. The sequences of the resulting PCR products are represented by the respective SEQ ID NOs as given in Table 2-AG and are referred to as the partial sequences. The corresponding partial amino acid sequence are represented by the respective SEQ ID NOs as given in Table 3-AG.

B. dsRNA Production of the *Anthonomus grandis* (Cotton Boll Weevil) Genes dsRNA was synthesized in milligram amounts using the commercially available kit T7 Ribomax™ Express RNAi System (Cat. Nr. P1700, Promega). First two separate single 5' T7 RNA polymerase promoter templates were generated in two separate PCR reactions, each reaction containing the target sequence in a different orientation relative to the T7 promoter.

For each of the target genes, the sense T7 template was generated using specific T7 forward and specific reverse primers. The sequences of the respective primers for amplifying the sense template for each of the target genes are given in Table 8-AG. A touchdown PCR was performed as follows: 1 minute at 95° C., followed by 20 cycles of 30 seconds at 95° C., 30 seconds at 60° C. with a decrease in temperature of 0.5° C. per cycle and 1 minute at 72° C., followed by 15 cycles of 30 seconds at 95° C., 30 seconds at 50° C. and 1 minute at 72° C., followed by 10 minutes at 72° C. The anti-sense T7 template was generated using specific forward and specific T7 reverse primers in a PCR reaction with the same conditions as described above. The sequences of the respective primers for amplifying the anti-sense template for each of the target genes are given in Table 8-AG. The resulting PCR products were analyzed on agarose gel and purified by PCR purification kit (Qiaquick PCR Purification Kit, Cat. Nr. 28106, Qiagen) and $NaClO_4$ precipitation. The generated T7 forward and reverse templates were mixed to be transcribed and the resulting RNA strands were annealed, DNase and RNase treated, and purified by sodium acetate, following the manufacturer's instructions. The sense strand of the resulting dsRNA for each of the target genes is given in Table 8-AG.

C. Cloning of a CBW Gene Fragment in a Vector Suitable for Bacterial Production of Insect-Active Double-Stranded RNA What follows is an example of cloning a DNA fragment corresponding to a CBW gene target in a vector for the expression of double-stranded RNA in a bacterial host, although any vector comprising a T7 promoter or any other promoter for efficient transcription in bacteria, may be used (reference to WO0001846).

The sequences of the specific primers used for the amplification of target genes are provided in Table 8-AG. The template used is the pCR8/GW/topo vector containing any of target sequences. The primers are used in a PCR reaction with the following conditions: 5 minutes at 98° C., followed by 30 cycles of 10 seconds at 98° C., 30 seconds at 55° C. and 2 minutes at 72° C., followed by 10 minutes at 72° C. The resulting PCR fragment is analyzed on agarose gel, purified (QIAquick Gel Extraction kit, Cat. Nr. 28706, Qiagen), blunt-end cloned into Srf I-linearized pGNA49A vector (reference to WO00188121A1), and sequenced. The sequence of the resulting PCR product corresponds to the respective sequence as given in Table 8-AG. The recombinant vector harboring this sequence is named pGXXX0XX.

D. Expression and Production of a Double-Stranded RNA Target in Two Strains of *Escherichia coli*: (1) AB301-105 (DE3), and, (2) BL21(DE3)

The procedures described below are followed in order to express suitable levels of insect-active double-stranded RNA of insect target in bacteria. An RNaseIII-deficient strain, AB301-105(DE3), is used in comparison to wild-type RNaseIII-containing bacteria, BL21(DE3).

Transformation of AB301-105(DE3) and BL21(DE3)

Three hundred ng of the plasmid are added to and gently mixed in a 50 μl aliquot of ice-chilled chemically competent *E. coli* strain AB301-105(DE3) or BL21(DE3). The cells are incubated on ice for 20 minutes before subjecting them to a heat shock treatment of 37° C. for 5 minutes, after which the cells are placed back on ice for a further 5 minutes. Four hundred and fifty μl of room temperature SOC medium is added to the cells and the suspension incubated on a shaker (250 rpm) at 37° C. for 1 hour. One hundred μl of the bacterial cell suspension is transferred to a 500 ml conical flask containing 150 ml of liquid Luria-Bertani (LB) broth supplemented with 100 μg/ml carbenicillin antibiotic. The culture is incubated on an Innova 4430 shaker (250 rpm) at 37° C. overnight (16 to 18 hours).

Chemical Induction of Double-Stranded RNA Expression in AB301-105(DE3) and BL21(DE3)

Expression of double-stranded RNA from the recombinant vector, pGXXX0XX, in the bacterial strain AB301-105 (DE3) or BL21(DE3) is made possible since all the genetic components for controlled expression are present. In the presence of the chemical inducer isopropylthiogalactoside, or IPTG, the T7 polymerase will drive the transcription of the target sequence in both antisense and sense directions since these are flanked by oppositely oriented T7 promoters.

The optical density at 600 nm of the overnight bacterial culture is measured using an appropriate spectrophotometer and adjusted to a value of 1 by the addition of fresh LB broth. Fifty ml of this culture is transferred to a 50 ml Falcon tube and the culture then centrifuged at 3000 g at 15° C. for 10 minutes. The supernatant is removed and the bacterial pellet resuspended in 50 ml of fresh S complete medium (SNC medium plus 5 µg/ml cholesterol) supplemented with 100 µg/ml carbenicillin and 1 mM IPTG. The bacteria are induced for 2 to 4 hours at room temperature.

Heat Treatment of Bacteria

Bacteria are killed by heat treatment in order to minimise the risk of contamination of the artificial diet in the test plates. However, heat treatment of bacteria expressing double-stranded RNA is not a prerequisite for inducing toxicity towards the insects due to RNA interference. The induced bacterial culture is centrifuged at 3000 g at room temperature for 10 minutes, the supernatant discarded and the pellet subjected to 80° C. for 20 minutes in a water bath. After heat treatment, the bacterial pellet is resuspended in 1.5 ml MilliQ water and the suspension transferred to a microfuge tube. Several tubes are prepared and used in the bioassays for each refreshment. The tubes are stored at −20° C. until further use.

E. Laboratory Trials to Test *Escherichia coli* Expressing dsRNA Targets Against *Anthonomus grandis*

Plant-Based Bioassays

Whole plants are sprayed with suspensions of chemically induced bacteria expressing dsRNA prior to feeding the plants to CBW. The are grown from in a plant growth room chamber. The plants are caged by placing a 500 ml plastic bottle upside down over the plant with the neck of the bottle firmly placed in the soil in a pot and the base cut open and covered with a fine nylon mesh to permit aeration, reduce condensation inside and prevent insect escape. CBW are placed on each treated plant in the cage. Plants are treated with a suspension of *E. coli* AB301-105(DE3) harboring the pGXXX0XX plasmids or pGN29 plasmid. Different quantities of bacteria are applied to the plants: for instance 66, 22, and 7 units, where one unit is defined as $10^9$ bacterial cells in 1 ml of a bacterial suspension at optical density value of 1 at 600 nm wavelength. In each case, a total volume of between 1 and 10 ml s sprayed on the plant with the aid of a vaporizer. One plant is used per treatment in this trial. The number of survivors are counted and the weight of each survivor recorded.

Spraying plants with a suspension of *E. coli* bacterial strain AB301-105(DE3) expressing target dsRNA from pGXXX0XX lead to a dramatic increase in insect mortality when compared to pGN29 control. These experiments show that double-stranded RNA corresponding to an insect gene target sequence produced in either wild-type or RNaseIII-deficient bacterial expression systems is toxic towards the insect in terms of substantial increases in insect mortality and growth/development delay for larval survivors. It is also clear from these experiments that an exemplification is provided for the effective protection of plants/crops from insect damage by the use of a spray of a formulation consisting of bacteria expressing double-stranded RNA corresponding to an insect gene target.

Example 7

*Tribolium castaneum* (Red Flour Beetle)

A. Cloning *Tribolium castaneum* Partial Sequences

High quality, intact RNA was isolated from all the different insect stages of *Tribolium castaneum* (red flour beetle; source: Dr. Lara Senior, Insect Investigations Ltd., Capital Business Park, Wentloog, Cardiff, CF3 2PX, Wales, UK) using TRIzol Reagent (Cat. Nr. 15596-026/15596-018, Invitrogen, Rockville, Md., USA) following the manufacturer's instructions. Genomic DNA present in the RNA preparation was removed by DNase treatment following the manafacturer's instructions (Cat. Nr. 1700, Promega). cDNA was generated using a commercially available kit (SuperScript™ III Reverse Transcriptase, Cat. Nr. 18080044, Invitrogen, Rockville, Md., USA) following the manufacturer's instructions.

To isolate cDNA sequences comprising a portion of the TC001, TC002, TC010, TC014 and TC015 genes, a series of PCR reactions with degenerate primers were performed using Amplitaq Gold (Cat. Nr. N8080240, Applied Biosystems) following the manufacturer's instructions.

The sequences of the degenerate primers used for amplification of each of the genes are given in Table 2-TC. These primers were used in respective PCR reactions with the following conditions: 10 minutes at 95° C., followed by 40 cycles of 30 seconds at 95° C., 1 minute at 50° C. and 1 minute and 30 seconds at 72° C., followed by 7 minutes at 72° C. (TC001, TC014, TC015); 10 minutes at 95° C., followed by 40 cycles of 30 seconds at 95° C., 1 minute at 54° C. and 2 minutes and 30 seconds at 72° C., followed by 7 minutes at 72° C. (TC010); 10 minutes at 95° C., followed by 40 cycles of 30 seconds at 95° C., 1 minute at 53° C. and 1 minute at 72° C., followed by 7 minutes at 72° C. (TC002). The resulting PCR fragments were analyzed on agarose gel, purified (QIAquick Gel Extraction kit, Cat. Nr. 28706, Qiagen), cloned into the pCR8/GW/TOPO vector (Cat. Nr. K2500-20, Invitrogen), and sequenced. The sequences of the resulting PCR products are represented by the respective SEQ ID NOs as given in Table 2-TC and are referred to as the partial sequences. The corresponding partial amino acid sequences are represented by the respective SEQ ID NOs as given in Table 3-TC.

B. dsRNA Production of the *Tribolium castaneum* Genes dsRNA was synthesized in milligram amounts using the commercially available kit T7 Ribomax™ Express RNAi System (Cat. Nr. P1700, Promega). First two separate single 5' T7 RNA polymerase promoter templates were generated in two separate PCR reactions, each reaction containing the target sequence in a different orientation relative to the T7 promoter.

For each of the target genes, the sense T7 template was generated using specific T7 forward and specific reverse primers. The sequences of the respective primers for amplifying the sense template for each of the target genes are given in Table 8-TC. The conditions in the PCR reactions were as follows: 1 minute at 95° C., followed by 20 cycles of 30 seconds at 95° C., 30 seconds at 60° C. (−0.5° C./cycle) and 1 minute at 72° C., followed by 15 cycles of 30 seconds at 95° C., 30 seconds at 50° C. and 1 minute at 72° C., followed by 10 minutes at 72° C. The anti-sense T7 template was generated using specific forward and specific T7 reverse primers in a PCR reaction with the same conditions as described above. The sequences of the respective primers for amplifying the anti-sense template for each of the target genes are given in Table 8-TC. The resulting PCR products were analyzed on agarose gel and purified by PCR purification kit (Qiaquick PCR Purification Kit, Cat. Nr. 28106, Qiagen) and NaClO$_4$ precipitation. The generated T7 forward and reverse templates were mixed to be transcribed and the resulting RNA strands were annealed, DNase and RNase treated, and purified by sodium acetate, following the manufacturer's instructions. The sense strand of the resulting dsRNA for each of the target genes is given in Table 8-TC.

C. Laboratory Trials to Test dsRNA Targets, Using Artificial Diet for Activity Against *Tribolium castaneum* Larvae The example provided below is an exemplification of the finding that the red flour beetle (RFB) larvae are susceptible to orally ingested dsRNA corresponding to own target genes.

Red flour beetles, *Tribolium castaneum*, were maintained at Insect Investigations Ltd. (origin: Imperial College of Science, Technology and Medicine, Silwood Park, Berkshire, UK). Insects were cultured according to company SOP/251/01. Briefly, the beetles were housed in plastic jars or tanks. These have an open top to allow ventilation. A piece of netting was fitted over the top and secured with an elastic band to prevent escape. The larval rearing medium (flour) was placed in the container where the beetles can breed. The stored product beetle colonies were maintained in a controlled temperature room at 25±3° C. with a 16:8 hour light:dark cycle.

Double-stranded RNA from target TC014 (with sequence corresponding to SEQ ID NO-799) was incorporated into a mixture of flour and milk powder (wholemeal flour:powdered milk in the ratio 4:1) and left to dry overnight. Each replicate was prepared separately: 100 μl of a 10 μg/μl dsRNA solution (1 mg dsRNA) was added to 0.1 g flour/milk mixture. The dried mixture was ground to a fine powder. Insects were maintained within Petri dishes (55 mm diameter), lined with a double layer of filter paper. The treated diet was placed between the two filter paper layers. Ten first instar, mixed sex larvae were placed in each dish (replicate). Four replicates were performed for each treatment. Control was Milli-Q water. Assessments (number of survivors) were made on a regular basis. During the trial, the test conditions were 25-33° C. and 20-25% relative humidity, with a 12:12 hour light:dark photoperiod.

Survival of larvae of *T. castaneum* over time on artificial diet treated with target TC014 dsRNA was significantly reduced when compared to diet only control, as shown in FIG. 1-TC.

D. Cloning of a RFB Gene Fragment in a Vector Suitable for Bacterial Production of Insect-Active Double-Stranded RNA What follows is an example of cloning a DNA fragment corresponding to an RFB gene target in a vector for the expression of double-stranded RNA in a bacterial host, although any vector comprising a T7 promoter or any other promoter for efficient transcription in bacteria, may be used (reference to WO0001846).

The sequences of the specific primers used for the amplification of target genes are provided in Table 8-TC. The template used is the pCR8/GW/topo vector containing any of target sequences. The primers are used in a PCR reaction with the following conditions: 5 minutes at 98° C., followed by 30 cycles of 10 seconds at 98° C., 30 seconds at 55° C. and 2 minutes at 72° C., followed by 10 minutes at 72° C. The resulting PCR fragment is analyzed on agarose gel, purified (QIAquick Gel Extraction kit, Cat. Nr. 28706, Qiagen), blunt-end cloned into Srf I-linearized pGNA49A vector (reference to WO00188121A1), and sequenced. The sequence of the resulting PCR product corresponds to the respective sequence as given in Table 8-TC. The recombinant vector harboring this sequence is named pGXXX0XX.

E. Expression and Production of a Double-Stranded RNA Target in Two Strains of *Escherichia coli*: (1) AB301-105 (DE3), and, (2) BL21(DE3)

The procedures described below are followed in order to express suitable levels of insect-active double-stranded RNA of insect target in bacteria. An RNaseIII-deficient strain, AB301-105(DE3), is used in comparison to wild-type RNaseIII-containing bacteria, BL21(DE3).

Transformation of AB301-105(DE3) and BL21(DE3)

Three hundred ng of the plasmid are added to and gently mixed in a 50 μl aliquot of ice-chilled chemically competent *E. coli* strain AB301-105(DE3) or BL21(DE3). The cells are incubated on ice for 20 minutes before subjecting them to a heat shock treatment of 37° C. for 5 minutes, after which the cells are placed back on ice for a further 5 minutes. Four hundred and fifty μl of room temperature SOC medium is added to the cells and the suspension incubated on a shaker (250 rpm) at 37° C. for 1 hour. One hundred μl of the bacterial cell suspension is transferred to a 500 ml conical flask containing 150 ml of liquid Luria-Bertani (LB) broth supplemented with 100 μg/ml carbenicillin antibiotic. The culture is incubated on an Innova 4430 shaker (250 rpm) at 37° C. overnight (16 to 18 hours).

Chemical Induction of Double-Stranded RNA Expression in AB301-105(DE3) and BL21(DE3)

Expression of double-stranded RNA from the recombinant vector, pGXXX0XX, in the bacterial strain AB301-105 (DE3) or BL21(DE3) is made possible since all the genetic components for controlled expression are present. In the presence of the chemical inducer isopropylthiogalactoside, or IPTG, the T7 polymerase will drive the transcription of the target sequence in both antisense and sense directions since these are flanked by oppositely oriented T7 promoters.

The optical density at 600 nm of the overnight bacterial culture is measured using an appropriate spectrophotometer and adjusted to a value of 1 by the addition of fresh LB broth. Fifty ml of this culture is transferred to a 50 ml Falcon tube and the culture then centrifuged at 3000 g at 15° C. for 10 minutes. The supernatant is removed and the bacterial pellet resuspended in 50 ml of fresh S complete medium (SNC medium plus 5 μg/ml cholesterol) supplemented with 100 μg/ml carbenicillin and 1 mM IPTG. The bacteria are induced for 2 to 4 hours at room temperature.

Heat Treatment of Bacteria

Bacteria are killed by heat treatment in order to minimise the risk of contamination of the artificial diet in the test plates. However, heat treatment of bacteria expressing double-stranded RNA is not a prerequisite for inducing toxicity towards the insects due to RNA interference. The induced bacterial culture is centrifuged at 3000 g at room temperature for 10 minutes, the supernatant discarded and the pellet subjected to 80° C. for 20 minutes in a water bath. After heat treatment, the bacterial pellet is resuspended in 1.5 ml MilliQ water and the suspension transferred to a microfuge tube. Several tubes are prepared and used in the bioassays for each refreshment. The tubes are stored at −20° C. until further use.

F. Laboratory Trials to Test *Escherichia coli* Expressing dsRNA Targets Against *Tribolium castaneum*

Plant-Based Bioassays

Whole plants are sprayed with suspensions of chemically induced bacteria expressing dsRNA prior to feeding the plants to RFB. The are grown from in a plant growth room chamber. The plants are caged by placing a 500 ml plastic bottle upside down over the plant with the neck of the bottle firmly placed in the soil in a pot and the base cut open and covered with a fine nylon mesh to permit aeration, reduce condensation inside and prevent insect escape. RFB are placed on each treated plant in the cage. Plants are treated with a suspension of *E. coli* AB301-105(DE3) harboring the pGXXX0XX plasmids or pGN29 plasmid. Different quantities of bacteria are applied to the plants: for instance 66, 22, and 7 units, where one unit is defined as $10^9$ bacterial cells in 1 ml of a bacterial suspension at optical density value of 1 at 600 nm wavelength. In each case, a total volume of between 1 and 10 ml s sprayed on the plant with the aid of a vaporizer. One plant is used per treatment in this trial. The number of survivors are counted and the weight of each survivor recorded.

Spraying plants with a suspension of *E. coli* bacterial strain AB301-105(DE3) expressing target dsRNA from pGXXX0XX leed to a dramatic increase in insect mortality when compared to pGN29 control. These experiments show that double-stranded RNA corresponding to an insect gene target sequence produced in either wild-type or RNaseIII-deficient bacterial expression systems is toxic towards the insect in terms of substantial increases in insect mortality and growth/development delay for larval survivors. It is also clear from these experiments that an exemplification is provided for the effective protection of plants/crops from insect damage by the use of a spray of a formulation consisting of bacteria expressing double-stranded RNA corresponding to an insect gene target.

Example 8

*Myzus persicae* (Green Peach Aphid)

A. Cloning *Myzus persicae* Partial Sequences

High quality, intact RNA was isolated from nymphs of *Myzus persicae* (green peach aphid; source: Dr. Rachel Down, Insect & Pathogen Interactions, Central Science Laboratory, Sand Hutton, York, YO41 1LZ, UK) using TRIzol Reagent (Cat. Nr. 15596-026/15596-018, Invitrogen, Rockville, Md., USA) following the manufacturer's instructions. Genomic DNA present in the RNA preparation was removed by DNase treatment following the manafacturer's instructions (Cat. Nr. 1700, Promega). cDNA was generated using a commercially available kit (SuperScript™ III Reverse Transcriptase, Cat. Nr. 18080044, Invitrogen, Rockville, Md., USA) following the manufacturer's instructions.

To isolate cDNA sequences comprising a portion of the MP001, MP002, MP010, MP016 and MP027 genes, a series of PCR reactions with degenerate primers were performed using Amplitaq Gold (Cat. Nr. N8080240, Applied Biosystems) following the manafacturer's instructions.

The sequences of the degenerate primers used for amplification of each of the genes are given in Table 2-MP. These primers were used in respective PCR reactions with the following conditions: for MP001, MP002 and MP016, 10 minutes at 95° C., followed by 40 cycles of 30 seconds at 95° C., 1 minute at 50° C. and 1 minute 30 seconds at 72° C., followed by 7 minutes at 72° C.; for MP027, a touchdown program was used: 10 minutes at 95° C., followed by 10 cycles of 30 seconds at 95° C., 40 seconds at 60° C. with a decrease in temperature of 1° C. per cycle and 1 minute 10 seconds at 72° C., followed by 30 cycles of 30 seconds at 95° C., 40 seconds at 50° C. and 1 minute 10 seconds at 72° C., followed by 7 minutes at 72° C.; for MP010, 10 minutes at 95° C., followed by 40 cycles of 30 seconds at 95° C., 1 minute at 54° C. and 3 minutes at 72° C., followed by 7 minutes at 72° C. The resulting PCR fragments were analyzed on agarose gel, purified (QIAquick Gel Extraction kit, Cat. Nr. 28706, Qiagen), cloned into the pCR8/GW/TOPO vector (Cat. Nr. K2500-20, Invitrogen), and sequenced. The sequences of the resulting PCR products are represented by the respective SEQ ID NOs as given in Table 2-MP and are referred to as the partial sequences. The corresponding partial amino acid sequences are represented by the respective SEQ ID NOs as given in Table 3-MP.

B. dsRNA Production of *Myzus persicae* Genes dsRNA was synthesized in milligram amounts using the commercially available kit T7 Ribomax™ Express RNAi System (Cat. Nr. P1700, Promega). First two separate single 5' T7 RNA polymerase promoter templates were generated in two separate PCR reactions, each reaction containing the target sequence in a different orientation relative to the T7 promoter.

For each of the target genes, the sense T7 template was generated using specific T7 forward and specific reverse primers. The sequences of the respective primers for amplifying the sense template for each of the target genes are given in Table 8-MP. A touchdown PCR was performed as follows: 1 minute at 95° C., followed by 20 cycles of 30 seconds at 95° C., 30 seconds at 55° C. (for MP001, MP002, MP016, MP027 and gfp) or 30 seconds at 50° C. (for MP010) with a decrease in temperature of 0.5° C. per cycle and 1 minute at 72° C., followed by 15 cycles of 30 seconds at 95° C., 30 seconds at 45° C. and 1 minute at 72° C. followed by 10 minutes at 72° C. The anti-sense T7 template was generated using specific forward and specific T7 reverse primers in a PCR reaction with the same conditions as described above. The sequences of the respective primers for amplifying the anti-sense template for each of the target genes are given in Table 8-MP. The resulting PCR products were analyzed on agarose gel and purified by PCR purification kit (Qiaquick PCR Purification Kit, Cat. Nr. 28106, Qiagen) and $NaClO_4$ precipitation. The generated T7 forward and reverse templates were mixed to be transcribed and the resulting RNA strands were annealed, DNase and RNase treated, and purified by sodium acetate, following the manufacturer's instructions. The sense strand of the resulting dsRNA for each of the target genes is given in Table 8-MP.

C. Laboratory Trials of *Myzus periscae* (Green Peach Aphid) Infestation on Transgenic *Arabidopsis thaliana* Plants Generation of Transgenic Plants

*Arabidopsis thaliana* plants were transformed using the floral dip method (Clough and Bent (1998) Plant Journal 16:735-743). Aerial parts of the plants were incubated for a few seconds in a solution containing 5% sucrose, resuspended *Agrobacterium tumefaciens* strain C58C1 Rif cells from an overnight culture and 0.03% of the surfactant Silwet L-77. After inoculation, plants were covered for 16 hours with a transparent plastic to maintain humidity. To increase the transformation efficiency, the procedure was repeated after one week. Watering was stopped as seeds matured and dry seeds were harvested and cold-treated for two days. After sterilization, seeds were plated on a kanamycin-containing growth medium for selection of transformed plants.

The selected plants are transferred to soil for optimal T2 seed production.

Bioassay

Transgenic *Arabidopsis thaliana* plants are selected by allowing the segregating T2 seeds to germinate on appropriate selection medium. When the roots of these transgenics are well-established they are then transferred to fresh artificial growth medium or soil and allowed to grow under optimal conditions. Whole transgenic plants are tested against nymphs of the green peach aphid (*Myzus persicae*) to show (1) a significant resistance to plant damage by the feeding nymph, (2) increased nymphal mortality, and/or (3) decreased weight of nymphal survivors (or any other aberrant insect development).

D. Laboratory Trials to Test dsRNA Targets Using Liquid Artificial Diet for Activity Against *Myzus persicae*

Liquid artificial diet for the green peach aphid, *Myzus persicae*, was prepared based on the diet suitable for pea aphids (*Acyrthosiphon pisum*), as described by Febvay et al. (1988) [Influence of the amino acid balance on the improvement of an artificial diet for a biotype of *Acyrthosiphon pisum* (Homoptera: Aphididae). *Can. J. Zool.* 66: 2449-2453], but with some modifications. The amino acids component of the diet was prepared as follows: in mg/100 ml, alanine 178.71, beta-alanine 6.22, arginine 244.9, asparagine 298.55, aspartic acid 88.25, cysteine 29.59, glutamic acid 149.36, glutamine 445.61, glycine 166.56, histidine 136.02, isoleucine 164.75, leucine 231.56, lysine hydrochloride 351.09, methionine 72.35, ornithine (HCl) 9.41, phenylalanine 293, proline 129.33, serine 124.28, threonine 127.16, tryptophane 42.75, tyrosine 38.63, L-valine 190.85. The amino acids were dissolved in 30 ml Milli-Q $H_2O$ except for tyrosine which was first dissolved in a few drops of 1 M HCl before adding to the amino acid mix. The vitamin mix component of the diet was prepared as a 5x concentrate stock as follows: in mg/L, amino benzoic acid 100, ascorbic acid 1000, biotin 1, calcium panthothenate 50, choline chloride 500, folic acid 10, myoinositol 420, nicotinic acid 100, pyridoxine hydrochloride 25, riboflavin 5, thiamine hydrochloride 25. The riboflavin was dissolved in 1 ml H2O at 50° C. and then added to the vitamin mix stock. The vitamin mix was aliquoted in 20 ml per aliquot and stored at −20° C. One aliquot of vitamin mix was added to the amino acid solution. Sucrose and $MgSO_4.7H_2O$ was added with the following amounts to the mix: 20 g and 242 mg, respectively. Trace metal stock solution was prepared as follows: in mg/100 ml, $CuSO_4.5H_2O$ 4.7, $FeCl_3.6H_2O$ 44.5, $MnCl_2.4H2O$ 6.5, NaCl 25.4, $ZnCl_2$ 8.3. Ten ml of the trace metal solution and 250 mg $KH_2PO_4$ was added to the diet and Milli-Q water was added to a final liquid diet volume of 100 ml. The pH of the diet was adjusted to 7 with 1 M KOH solution. The liquid diet was filter-sterilised through an 0.22 µm filter disc (Millipore).

Green peach aphids (*Myzus persicae*; source: Dr. Rachel Down, Insect & Pathogen Interactions, Central Science Laboratory, Sand Hutton, York, YO41 1LZ, UK) were reared on 4- to 6-week-old oilseed rape (*Brassica napus* variety SW Oban; source: Nick Balaam, Sw Seed Ltd., 49 North Road, Abington, Cambridge, CB1 6AS, UK) in aluminium-framed cages containing 70 µm mesh in a controlled environment chamber with the following conditions: 23±2° C. and 60±5% relative humidity, with a 16:8 hours light:dark photoperiod.

One day prior to the start of the bioassay, adults were collected from the rearing cages and placed on fresh detached oilseed rape leaves in a Petri dish and left overnight in the insect chamber. The following day, first-instar nymphs were picked and transferred to feeding chambers. A feeding chamber comprised of 10 first instar nymphs placed in a small Petri dish (with diameter 3 cm) covered with a single layer of thinly stretched parafilm M onto which 50 µl of diet was added. The chamber was sealed with a second layer of parafilm and incubated under the same conditions as the adult cultures. Diet with dsRNA was refreshed every other day and the insects' survival assessed on day 8 i.e. $8^{th}$ day post bioassay start. Per treatment, 5 bioassay feeding chambers (replicates) were set up simultaneously. Test and control (gfp) dsRNA solutions were incorporated into the diet to a final concentration of 2 µg/µl. The feeding chambers were kept at 23±2° C. and 60±5% relative humidity, with a 16:8 hours light:dark photoperiod. A Mann-Whitney test was determined by GraphPad Prism version 4 to establish whether the medians do differ significantly between target 27 (MP027) and gfp dsRNA.

In the bioassay, feeding liquid artificial diet supplemented with intact naked dsRNA from target 27 (SEQ ID NO 1061) to nymphs of *Myzus persicae* using a feeding chamber, resulted in a significant increase in mortality, as shown in FIG. 1. Average percentage survivors for target 27, gfp dsRNA and diet only treatment were 2, 34 and 82, respectively. Comparison of target 027 with gfp dsRNA groups using the Mann-Whitney test resulted in an one-tailed P-value of 0.004 which indicates that the median of target 027 is significantly different (P<0.05) from the expected larger median of gfp dsRNA. The green peach aphids on the liquid diet with incorporated target 27 dsRNA were noticeably smaller than those that were fed on diet only or with gfp dsRNA control (data not presented).

E. Cloning of a GPA Gene Fragment in a Vector Suitable for Bacterial Production of Insect-Active Double-Stranded RNA What follows is an example of cloning a DNA fragment corresponding to a GPA gene target in a vector for the expression of double-stranded RNA in a bacterial host, although any vector comprising a T7 promoter or any other promoter for efficient transcription in bacteria, may be used (reference to WO0001846).

The sequences of the specific primers used for the amplification of target genes are provided in Table 8-MP. The template used is the pCR8/GW/topo vector containing any of target sequences. The primers are used in a PCR reaction with the following conditions: 5 minutes at 98° C., followed by 30 cycles of 10 seconds at 98° C., 30 seconds at 55° C. and 2 minutes at 72° C., followed by 10 minutes at 72° C. The resulting PCR fragment is analyzed on agarose gel, purified (QIAquick Gel Extraction kit, Cat. Nr. 28706, Qiagen), blunt-end cloned into Srf I-linearized pGNA49A vector (reference to WO00188121A1), and sequenced. The sequence of the resulting PCR product corresponds to the respective sequence as given in Table 8-MP. The recombinant vector harboring this sequence is named pGXXX0XX.

F. Expression and Production of a Double-Stranded RNA Target in Two Strains of *Escherichia coli*: (1) AB301-105 (DE3), and, (2) BL21(DE3)

The procedures described below are followed in order to express suitable levels of insect-active double-stranded RNA of insect target in bacteria. An RNaseIII-deficient strain, AB301-105(DE3), is used in comparison to wild-type RNaseIII-containing bacteria, BL21(DE3).

Transformation of AB301-105(DE3) and BL21(DE3)

Three hundred ng of the plasmid are added to and gently mixed in a 50 µl aliquot of ice-chilled chemically competent *E. coli* strain AB301-105(DE3) or BL21(DE3). The cells are incubated on ice for 20 minutes before subjecting them to a heat shock treatment of 37° C. for 5 minutes, after which the cells are placed back on ice for a further 5 minutes. Four hundred and fifty µl of room temperature SOC medium is added to the cells and the suspension incubated on a shaker (250 rpm) at 37° C. for 1 hour. One hundred µl of the bacterial cell suspension is transferred to a 500 ml conical flask containing 150 ml of liquid Luria-Bertani (LB) broth supplemented with 100 µg/ml carbenicillin antibiotic. The culture is incubated on an Innova 4430 shaker (250 rpm) at 37° C. overnight (16 to 18 hours).

Chemical Induction of Double-Stranded RNA Expression in AB301-105(DE3) and BL21(DE3)

Expression of double-stranded RNA from the recombinant vector, pGXXX0XX, in the bacterial strain AB301-105 (DE3) or BL21(DE3) is made possible since all the genetic components for controlled expression are present. In the presence of the chemical inducer isopropylthiogalactoside, or IPTG, the T7 polymerase will drive the transcription of the target sequence in both antisense and sense directions since these are flanked by oppositely oriented T7 promoters.

The optical density at 600 nm of the overnight bacterial culture is measured using an appropriate spectrophotometer and adjusted to a value of 1 by the addition of fresh LB broth. Fifty ml of this culture is transferred to a 50 ml Falcon tube and the culture then centrifuged at 3000 g at 15° C. for 10 minutes. The supernatant is removed and the bacterial pellet resuspended in 50 ml of fresh S complete medium (SNC medium plus 5 µg/ml cholesterol) supplemented with 100 µg/ml carbenicillin and 1 mM IPTG. The bacteria are induced for 2 to 4 hours at room temperature.

Heat Treatment of Bacteria

Bacteria are killed by heat treatment in order to minimise the risk of contamination of the artificial diet in the test plates. However, heat treatment of bacteria expressing double-stranded RNA is not a prerequisite for inducing toxicity towards the insects due to RNA interference. The induced bacterial culture is centrifuged at 3000 g at room temperature for 10 minutes, the supernatant discarded and the pellet subjected to 80° C. for 20 minutes in a water bath. After heat treatment, the bacterial pellet is resuspended in 1.5 ml MilliQ water and the suspension transferred to a microfuge tube. Several tubes are prepared and used in the bioassays for each refreshment. The tubes are stored at –20° C. until further use.

G. Laboratory Trials to Test *Escherichia coli* Expressing dsRNA Targets Against *Myzus persicae*

Plant-Based Bioassays

Whole plants are sprayed with suspensions of chemically induced bacteria expressing dsRNA prior to feeding the plants to GPA. The are grown from in a plant growth room chamber. The plants are caged by placing a 500 ml plastic bottle upside down over the plant with the neck of the bottle firmly placed in the soil in a pot and the base cut open and covered with a fine nylon mesh to permit aeration, reduce condensation inside and prevent insect escape. GPA are placed on each treated plant in the cage. Plants are treated with a suspension of *E. coli* AB301-105(DE3) harboring the pGXXX0XX plasmids or pGN29 plasmid. Different quantities of bacteria are applied to the plants: for instance 66, 22, and 7 units, where one unit is defined as $10^9$ bacterial cells in 1 ml of a bacterial suspension at optical density value of 1 at 600 nm wavelength. In each case, a total volume of between 1 and 10 ml s sprayed on the plant with the aid of a vaporizer. One plant is used per treatment in this trial. The number of survivors are counted and the weight of each survivor recorded.

Spraying plants with a suspension of *E. coli* bacterial strain AB301-105(DE3) expressing target dsRNA from pGXXX0XX lead to a dramatic increase in insect mortality when compared to pGN29 control. These experiments show that double-stranded RNA corresponding to an insect gene target sequence produced in either wild-type or RNaseIII-deficient bacterial expression systems is toxic towards the insect in terms of substantial increases in insect mortality and growth/development delay for larval survivors. It is also clear from these experiments that an exemplification is provided for the effective protection of plants/crops from insect damage by the use of a spray of a formulation consisting of bacteria expressing double-stranded RNA corresponding to an insect gene target.

Example 9

*Nilaparvata lugens* (Brown Plant Hopper)

A. Cloning *Nilaparvata lugens* Partial Sequences

From high quality total RNA of *Nilaparvata lugens* (source: Dr. J. A. Gatehouse, Dept. Biological Sciences, Durham University, UK) cDNA was generated using a commercially available kit (SuperScript™ III Reverse Transcriptase, Cat N°. 18080044, Invitrogen, Rockville, Md., USA) following the manufacturer's protocol.

To isolate cDNA sequences comprising a portion of the *Nilaparvata lugens* NL001, NL002, NL003, NL004, NL005, NL006, NL007, NL008, NL009, NL010, NL011, NL012, NL013, NL014, NL015, NL016, NL018, NL019, NL021, NL022, and NL027 genes, a series of PCR reactions with degenerate primers were performed using Amplitaq Gold (Cat N°. N8080240; Applied Biosystems) following the manufacturer's protocol.

The sequences of the degenerate primers used for amplification of each of the genes are given in Table 2-NL. These primers were used in respective PCR reactions with the following conditions: for NL001: 5 minutes at 95° C., followed by 40 cycles of 30 seconds at 95° C., 1 minute at 55° C. and 1 minute at 72° C., followed by 10 minutes at 72° C.: for NL002: 3 minutes at 95° C., followed by 40 cycles of 30 seconds at 95° C., 1 minute at 55° C. and 1 minute at 72° C., followed by 10 minutes at 72° C.; for NL003: 3 minutes at 95° C., followed by 40 cycles of 30 seconds at 95° C., 1 minute at 61° C. and 1 minute at 72° C., followed by 10 minutes at 72° C.; for NL004: 10 minutes at 95° C., followed by 40 cycles of 30 seconds at 95° C., 1 minute at 51° C. and 1 minute at 72° C.; for NL005: 10 minutes at 95° C., followed by 40 cycles of 30 seconds at 95° C., 1 minute at 54° C. and 1 minute at 72° C., followed by 10 minutes at 72° C.; for NL006: 10 minutes at 95° C., followed by 40 cycles of 30 seconds at 95° C., 1 minute at 55° C. and 3 minute 30 seconds at 72° C., followed by 10 minutes at 72° C.; for NL007: 10 minutes at 95° C., followed by 40 cycles of 30 seconds at 95° C., 1 minute at 54° C. and 1 minute 15 seconds at 72° C., followed by 10 minutes at 72° C.; for NL008 & NL014: 10 minutes at 95° C., followed by 40 cycles of 30 seconds at 95° C., 1 minute at 53° C. and 1 minute at 72° C., followed by 10 minutes at 72° C.; for NL009, NL011, NL012 & NL019: 10 minutes at 95° C., followed by 40 cycles of 30 seconds at 95° C., 1 minute at 55° C. and 1 minute at 72° C., followed by 10 minutes at 72° C.; for NL010: 10 minutes at 95° C., followed by 40 cycles of 30 seconds at 95° C., 1 minute at 54° C. and 2 minute 30 seconds at 72° C., followed by 10 minutes at 72° C.; for NL013: 10 minutes at 95° C., followed by 40 cycles of 30 seconds at 95° C., 1 minute at 54° C. and 1 minute 10 seconds at 72° C., followed by 10 minutes at 72° C.; for NL015 & NL016: 10 minutes at 95° C., followed by 40 cycles of 30 seconds at 95° C., 1 minute at 54° C. and 1 minute 40 seconds at 72° C., followed by 10 minutes at 72° C.; for NL018: 10 minutes at 95° C., followed by 40 cycles of 30 seconds at 95° C., 1 minute at 54° C. and 1 minute 35 seconds at 72° C., followed by 10 minutes at 72° C.; for NL021, NL022 & NL027: 10 minutes at 95° C., followed by 40 cycles of 30 seconds at 95° C., 1 minute at 54° C. and 1 minute 45 seconds at 72° C., followed by 10 minutes at 72° C. The resulting PCR fragments were analyzed on agarose gel, purified (QIAquick Gel Extraction kit, Cat. Nr. 28706, Qiagen), cloned into the pCR8/

GW/topo vector (Cat. Nr. K2500 20, Invitrogen), and sequenced. The sequences of the resulting PCR products are represented by the respective SEQ ID NOs as given in Table 2-NL and are referred to as the partial sequences. The corresponding partial amino acid sequences are represented by the respective SEQ ID NOs as given in Table 3-NL.

B. Cloning of a Partial Sequence of the *Nilaparvata lugens* NL023 Gene Via EST Sequence From high quality total RNA of *Nilaparvata lugens* (source: Dr. J. A. Gatehouse, Dept. Biological Sciences, Durham University, UK) cDNA was generated using a commercially available kit (SuperScript™ III Reverse Transcriptase, Cat N°. 18080044, Invitrogen, Rockville, Md., USA) following the manufacturer's protocol.

A partial cDNA sequence, NL023, was amplified from *Nilaparvata lugens* cDNA which corresponded to a *Nilaparvata lugens* EST sequence in the public database Genbank with accession number CAH65679.2. To isolate cDNA sequences comprising a portion of the NL023 gene, a series of PCR reactions with EST based specific primers were performed using PerfectShot™ ExTaq (Cat N°. RR005A, Takara Bio Inc.) following the manufacturer's protocol.

For NL023, the specific primers oGBKW002 and oGBKW003 (represented herein as SEQ ID NO 1157 and SEQ ID NO 1158, respectively) were used in two independent PCR reactions with the following conditions: 3 minutes at 95° C., followed by 30 cycles of 30 seconds at 95° C., 30 seconds at 56° C. and 2 minutes at 72° C., followed by 10 minutes at 72° C. The resulting PCR products were analyzed on agarose gel, purified (QIAquick® Gel Extraction Kit; Cat. N°. 28706, Qiagen), cloned into the pCR4-TOPO vector (Cat N°. K4575-40, Invitrogen) and sequenced. The consensus sequence resulting from the sequencing of both PCR products is herein represented by SEQ ID NO 1111 and is referred to as the partial sequence of the NL023 gene. The corresponding partial amino acid sequence is herein represented as SEQ ID NO 1112.

C. dsRNA Production of *Nilaparvata lugens* Genes dsRNA was synthesized in milligram amounts using the commercially available kit T7 Ribomax™ Express RNAi System (Cat. Nr. P1700, Promega). First two separate single 5' T7 RNA polymerase promoter templates were generated in two separate PCR reactions, each reaction containing the target sequence in a different orientation relative to the T7 promoter.

For each of the target genes, the sense T7 template was generated using specific T7 forward and specific reverse primers. The sequences of the respective primers for amplifying the sense template for each of the target genes are given in Table 8-NL. The conditions in the PCR reactions were as follows: for NL001 & NL002: 4 minutes at 94° C., followed by 35 cycles of 30 seconds at 94° C., 30 seconds at 60° C. and 1 minute at 72° C., followed by 10 minutes at 72° C.; for NL003: 4 minutes at 94° C., followed by 35 cycles of 30 seconds at 94° C., 30 seconds at 66° C. and 1 minute at 72° C., followed by 10 minutes at 72° C.; for NL004, NL006, NL008, NL009, NL010 & NL019: 4 minutes at 95° C., followed by 35 cycles of 30 seconds at 95° C., 30 seconds at 54° C. and 1 minute at 72° C., followed by 10 minutes at 72° C.; for NL005 & NL016: 4 minutes at 95° C., followed by 35 cycles of 30 seconds at 95° C., 30 seconds at 57° C. and 1 minute at 72° C., followed by 10 minutes at 72° C.; for NL007 & NL014: 4 minutes at 95° C., followed by 35 cycles of 30 seconds at 95° C., 30 seconds at 51° C. and 1 minute at 72° C., followed by 10 minutes at 72° C.; for NL011, NL012 & NL022: 4 minutes at 95° C., followed by 35 cycles of 30 seconds at 95° C., 30 seconds at 53° C. and 1 minute at 72° C., followed by 10 minutes at 72° C.; for NL013, NL015, NL018 & NL021: 4 minutes at 95° C., followed by 35 cycles of 30 seconds at 95° C., 30 seconds at 55° C. and 1 minute at 72° C., followed by 10 minutes at 72° C.; for NL023 & NL027: 4 minutes at 95° C., followed by 35 cycles of 30 seconds at 95° C., 30 seconds at 52° C. and 1 minute at 72° C., followed by 10 minutes at 72° C. The anti-sense T7 template was generated using specific forward and specific T7 reverse primers in a PCR reaction with the same conditions as described above. The sequences of the respective primers for amplifying the anti-sense template for each of the target genes are given in Table 8-NL. The resulting PCR products were analyzed on agarose gel and purified by PCR purification kit (Qiaquick PCR Purification Kit, Cat. Nr. 28106, Qiagen). The generated T7 forward and reverse templates were mixed to be transcribed and the resulting RNA strands were annealed, DNase and RNase treated, and purified by sodium acetate, following the manufacturer's instructions, but with the following modification: RNA peppet is washed twice in 70% ethanol. The sense strand of the resulting dsRNA for each of the target genes is given in Table 8-NL.

The template DNA used for the PCR reactions with T7 primers on the green fluorescent protein (gfp) control was the plasmid pPD96.12 (the Fire Lab, http://genome-www.stanford.edu/group/fire/), which contains the wild-type gfp coding sequence interspersed by 3 synthetic introns. Double-stranded RNA was synthesized using the commercially available kit T7 RiboMAX™ Express RNAi System (Cat. N°. P1700, Promega). First two separate single 5' T7 RNA polymerase promoter templates were generated in two separate PCR reactions, each reaction containing the target sequence in a different orientation relative to the T7 promoter. For gfp, the sense T7 template was generated using the specific T7 FW primer oGAU183 and the specific RV primer oGAU182 (represented herein as SEQ ID NO 236 and SEQ ID NO 237, respectively) in a PCR reaction with the following conditions: 4 minutes at 95° C., followed by 35 cycles of 30 seconds at 95° C., 30 seconds at 55° C. and 1 minute at 72° C., followed by 10 minutes at 72° C. The anti-sense T7 template was generated using the specific FW primer oGAU181 and the specific T7 RV primer oGAU184 (represented herein as SEQ ID NO 238 and SEQ ID NO 239, respectively) in a PCR reaction with the same conditions as described above. The resulting PCR products were analyzed on agarose gel and purified (QIAquick® PCR Purification Kit; Cat. N°. 28106, Qiagen). The generated T7 FW and RV templates were mixed to be transcribed and the resulting RNA strands were annealed, DNase and RNase treated, and purified by precipitation with sodium acetate and isopropanol, following the manufacturer's protocol, but with the following modification: RNA peppet is washed twice in 70% ethanol. The sense strands of the resulting dsRNA is herein represented by SEQ ID NO 235.

D. Laboratory Trials to Screen dsRNA Targets Using Liquid Artificial Diet for Activity Against *Nilaparvata lugens*

Liquid artificial diet (MMD-1) for the rice brown planthopper, *Nilaparvata lugens*, was prepared as described by Koyama (1988) [Artificial rearing and nutritional physiology of the planthoppers and leafhoppers (Homoptera: Delphacidae and Deltocephalidae) on a holidic diet. *JARQ* 22: 20-27], but with a modification in final concentration of diet component sucrose: 14.4% (weight over volume) was used. Diet components were prepared as separate concentrates: 10× mineral stock (stored at 4° C.), 2×amino acid stock (stored at −20° C.) and 10× vitamin stock (stored at −20° C.). The stock components were mixed immediately prior to the start of a bioassay to 4/3× concentration to allow dilution with the test dsRNA solution (4× concentration), pH adjusted to 6.5, and filter-sterilised into approximately 500 µl aliquots.

Rice brown planthopper (*Nilaparvata lugens*) was reared on two-to-three month old rice (*Oryza sativa* cv Taichung Native 1) plants in a controlled environment chamber: 27±2° C., 80% relative humidity, with a 16:8 hours light:dark photoperiod. A feeding chamber comprised 10 first or second instar nymphs placed in a small petri dish (with diameter 3 cm) covered with a single layer of thinly stretched parafilm M onto which 50 µl of diet was added. The chamber was sealed with a second layer of parafilm and incubated under the same conditions as the adult cultures but with no direct light exposure. Diet with dsRNA was refreshed every other day and the insects' survival assessed daily. Per treatment, 5 bioassay feeding chambers (replicates) were set up simultaneously. Test and control (gfp) dsRNA solutions were incorporated into the diet to a final concentration of 2 mg/ml. The feeding chambers were kept at 27±2° C., 80% relative humidity, with a 16:8 hours light:dark photoperiod. Insect survival data were analysed using the Kaplan-Meier survival curve model and the survival between groups were compared using the logrank test (Prism version 4.0).

Feeding liquid artificial diet supplemented with intact naked dsRNAs to *Nilaparvata lugens* in vitro using a feeding chamber resulted in significant increases in nymphal mortalities as shown in four separate bioassays (FIGS. 1(*a*)-(*d*)-NL; Tables 10-NL(a)-(d)) (Durham University). These results demonstrate that dsRNAs corresponding to different essential BPH genes showed significant toxicity towards the rice brown planthopper.

Effect of gfp dsRNA on BPH survival in these bioassays is not significantly different to survival on diet only Tables 10-NL(a)-(d) show a summary of the survival of *Nilaparvata lugens* on artificial diet supplemented with 2 mg/ml (final concentration) of the following targets; in Table 10-NL(a): NL002, NL003, NL005, NL010; in Table 10-NL (b): NL009, NL016; in Table 10-NL(c): NL014, NL018; and in Table 10-NL(d): NL013, NL015, NL021. In the survival analysis column, the effect of RNAi is indicated as follows: +=significantly decreased survival compared to gfp dsRNA control (alpha<0.05); −=no significant difference in survival compared to gfp dsRNA control. Survival curves were compared (between diet only and diet supplemented with test dsRNA, gfp dsRNA and test dsRNA, and diet only and gfp dsRNA) using the logrank test.

E. Laboratory Trials to Screen dsRNAs at Different Concentrations Using Artificial Diet for Activity Against *Nilaparvata lugens*

Fifty µl of liquid artificial diet supplemented with different concentrations of target NL002 dsRNA, namely 1, 0.2, 0.08, and 0.04 mg/ml (final concentration), was applied to the brown planthopper feeding chambers. Diet with dsRNA was refreshed every other day and the insects' survival assessed daily. Per treatment, 5 bioassay feeding chambers (replicates) were set up simultaneously. The feeding chambers were kept at 27±2° C., 80% relative humidity, with a 16:8 hours light: dark photoperiod. Insect survival data were analysed using the Kaplan-Meier survival curve model and the survival between groups were compared using the logrank test (Prism version 4.0).

Feeding liquid artificial diet supplemented with intact naked dsRNAs of target NL002 at different concentrations resulted in significantly higher BPH mortalities at final concentrations of as low as 0.04 mg dsRNA per ml diet when compared with survival on diet only, as shown in FIG. 2-NL and Table 11-NL. Table 11-NL summarizes the survival of *Nilaparvata lugens* artificial diet feeding trial supplemented with 1, 0.2, 0.08, & 0.04 mg/ml (final concentration) of target NL002. In the survival analysis column the effect of RNAi is indicated as follows: +=significantly decreases survival compared to diet only control (alpha<0.05); −=no significant differences in survival compared to diet only control. Survival curves were compared using the logrank test.

F. Cloning of a BPH Gene Fragment in a Vector Suitable for Bacterial Production of Insect-Active Double-Stranded RNA What follows is an example of cloning a DNA fragment corresponding to a BPH gene target in a vector for the expression of double-stranded RNA in a bacterial host, although any vector comprising a T7 promoter or any other promoter for efficient transcription in bacteria, may be used (reference to WO0001846).

The sequences of the specific primers used for the amplification of target genes are provided in Table 8-NL. The template used is the pCR8/GW/topo vector containing any of target sequences. The primers are used in a PCR reaction with the following conditions: 5 minutes at 98° C., followed by 30 cycles of 10 seconds at 98° C., 30 seconds at 55° C. and 2 minutes at 72° C., followed by 10 minutes at 72° C. The resulting PCR fragment is analyzed on agarose gel, purified (QIAquick Gel Extraction kit, Cat. Nr. 28706, Qiagen), blunt-end cloned into Srf I-linearized pGNA49A vector (reference to WO00188121A1), and sequenced. The sequence of the resulting PCR product corresponds to the respective sequence as given in Table 8-NL. The recombinant vector harboring this sequence is named pGXXX0XX.

G. Expression and Production of a Double-Stranded RNA Target in Two Strains of *Escherichia coli*: (1) AB301-105 (DE3), and, (2) BL21(DE3)

The procedures described below are followed in order to express suitable levels of insect-active double-stranded RNA of insect target in bacteria. An RNaseIII-deficient strain, AB301-105(DE3), is used in comparison to wild-type RNaseIII-containing bacteria, BL21(DE3).

Transformation of AB301-105(DE3) and BL21(DE3)

Three hundred ng of the plasmid are added to and gently mixed in a 50 µl aliquot of ice-chilled chemically competent *E. coli* strain AB301-105(DE3) or BL21(DE3). The cells are incubated on ice for 20 minutes before subjecting them to a heat shock treatment of 37° C. for 5 minutes, after which the cells are placed back on ice for a further 5 minutes. Four hundred and fifty µl of room temperature SOC medium is added to the cells and the suspension incubated on a shaker (250 rpm) at 37° C. for 1 hour. One hundred µl of the bacterial cell suspension is transferred to a 500 ml conical flask containing 150 ml of liquid Luria-Bertani (LB) broth supplemented with 100 µg/ml carbenicillin antibiotic. The culture is incubated on an Innova 4430 shaker (250 rpm) at 37° C. overnight (16 to 18 hours).

Chemical Induction of Double-Stranded RNA Expression in AB301-105(DE3) and BL21(DE3)

Expression of double-stranded RNA from the recombinant vector, pGXXX0XX, in the bacterial strain AB301-105 (DE3) or BL21(DE3) is made possible since all the genetic components for controlled expression are present. In the presence of the chemical inducer isopropylthiogalactoside, or IPTG, the T7 polymerase will drive the transcription of the target sequence in both antisense and sense directions since these are flanked by oppositely oriented T7 promoters.

The optical density at 600 nm of the overnight bacterial culture is measured using an appropriate spectrophotometer and adjusted to a value of 1 by the addition of fresh LB broth. Fifty ml of this culture is transferred to a 50 ml Falcon tube and the culture then centrifuged at 3000 g at 15° C. for 10 minutes. The supernatant is removed and the bacterial pellet resuspended in 50 ml of fresh S complete medium (SNC medium plus 5 µg/ml cholesterol) supplemented with 100 µg/ml carbenicillin and 1 mM IPTG. The bacteria are induced for 2 to 4 hours at room temperature.

Heat Treatment of Bacteria

Bacteria are killed by heat treatment in order to minimise the risk of contamination of the artificial diet in the test plates. However, heat treatment of bacteria expressing double-stranded RNA is not a prerequisite for inducing toxicity towards the insects due to RNA interference. The induced bacterial culture is centrifuged at 3000 g at room temperature for 10 minutes, the supernatant discarded and the pellet subjected to 80° C. for 20 minutes in a water bath. After heat treatment, the bacterial pellet is resuspended in 1.5 ml MilliQ water and the suspension transferred to a microfuge tube. Several tubes are prepared and used in the bioassays for each refreshment. The tubes are stored at −20° C. until further use.

H. Laboratory Trials to Test *Escherichia coli* Expressing dsRNA Targets Against *Nilaparvata lugens*

Plant-Based Bioassays

Whole plants are sprayed with suspensions of chemically induced bacteria expressing dsRNA prior to feeding the plants to BPH. The are grown from in a plant growth room chamber. The plants are caged by placing a 500 ml plastic bottle upside down over the plant with the neck of the bottle firmly placed in the soil in a pot and the base cut open and covered with a fine nylon mesh to permit aeration, reduce condensation inside and prevent insect escape. BPH are placed on each treated plant in the cage. Plants are treated with a suspension of *E. coli* AB301-105(DE3) harboring the pGXXX0XX plasmids or pGN29 plasmid. Different quantities of bacteria are applied to the plants: for instance 66, 22, and 7 units, where one unit is defined as $10^9$ bacterial cells in 1 ml of a bacterial suspension at optical density value of 1 at 600 nm wavelength. In each case, a total volume of between 1 and 10 ml s sprayed on the plant with the aid of a vaporizer. One plant is used per treatment in this trial. The number of survivors are counted and the weight of each survivor recorded.

Spraying plants with a suspension of *E. coli* bacterial strain AB301-105(DE3) expressing target dsRNA from pGXXX0XX leed to a dramatic increase in insect mortality when compared to pGN29 control. These experiments show that double-stranded RNA corresponding to an insect gene target sequence produced in either wild-type or RNaseIII-deficient bacterial expression systems is toxic towards the insect in terms of substantial increases in insect mortality and growth/development delay for larval survivors. It is also clear from these experiments that an exemplification is provided for the effective protection of plants/crops from insect damage by the use of a spray of a formulation consisting of bacteria expressing double-stranded RNA corresponding to an insect gene target.

Example 10

*Chilo suppressalis* (Rice Striped Stem Borer)

A. Cloning of Partial Sequence of the *Chilo suppressalis* Genes Via Family PCR

High quality, intact RNA was isolated from the 4 different larval stages of *Chilo suppressalis* (rice striped stem borer) using TRIzol Reagent (Cat. Nr. 15596-026/15596-018, Invitrogen, Rockville, Md., USA) following the manufacturer's instructions. Genomic DNA present in the RNA preparation was removed by DNase treatment following the manafacturer's instructions (Cat. Nr. 1700, Promega). cDNA was generated using a commercially available kit (SuperScript™ III Reverse Transcriptase, Cat. Nr. 18080044, Invitrogen, Rockville, Md., USA) following the manufacturer's instructions.

To isolate cDNA sequences comprising a portion of the CS001, CS002, CS003, CS006, CS007, CS009, CS011, CS013, CS014, CS015, CS016 and CS018 genes, a series of PCR reactions with degenerate primers were performed using Amplitaq Gold (Cat. Nr. N8080240, Applied Biosystems) following the manafacturer's instructions.

The sequences of the degenerate primers used for amplification of each of the genes are given in Table 2-CS. These primers were used in respective PCR reactions with the following conditions: 10 minutes at 95° C., followed by 40 cycles of 30 seconds at 95° C., 1 minute at 55° C. and 1 minute at 72° C., followed by 10 minutes at 72° C. The resulting PCR fragments were analyzed on agarose gel, purified (QIAquick Gel Extraction kit, Cat. Nr. 28706, Qiagen), cloned into the pCR4/TOPO vector (Cat. Nr. K2500-20, Invitrogen), and sequenced. The sequences of the resulting PCR products are represented by the respective SEQ ID NOs as given in Table 2-CS and are referred to as the partial sequences. The corresponding partial amino acid sequences are represented by the respective SEQ ID NOs as given in Table 3-CS.

B. dsRNA Production of the *Chilo suppressalis* Genes dsRNA was synthesized in milligram amounts using the commercially available kit T7 Ribomax™ Express RNAi System (Cat. Nr. P1700, Promega). First two separate single 5' T7 RNA polymerase promoter templates were generated in two separate PCR reactions, each reaction containing the target sequence in a different orientation relative to the T7 promoter.

For each of the target genes, the sense T7 template was generated using specific T7 forward and specific reverse primers. The sequences of the respective primers for amplifying the sense template for each of the target genes are given in Table 8-CS. The conditions in the PCR reactions were as follows: 4 minutes at 95° C., followed by 35 cycles of 30 seconds at 95° C., 30 seconds at 55° C. and 1 minute at 72° C., followed by 10 minutes at 72° C. The anti-sense T7 template was generated using specific forward and specific T7 reverse primers in a PCR reaction with the same conditions as described above. The sequences of the respective primers for amplifying the anti-sense template for each of the target genes are given in Table 8-CS. The resulting PCR products were analyzed on agarose gel and purified by PCR purification kit (Qiaquick PCR Purification Kit, Cat. Nr. 28106, Qiagen) and $NaClO_4$ precipitation. The generated T7 forward and reverse templates were mixed to be transcribed and the resulting RNA strands were annealed, DNase and RNase treated, and purified by sodium acetate, following the manufacturer's instructions. The sense strand of the resulting dsRNA for each of the target genes is given in Table 8-CS.

C. Laboratory Trials to Test dsRNA Targets, Using Artificial Diet for Activity Against *Chilo suppressalis* Larvae Rice striped stem borers, *Chilo suppressalis*, (origin: Syngenta, Stein, Switzerland) were maintained on a modified artificial diet based on that described by Kamano and Sato, 1985 (in: Handbook of Insect Rearing. Volumes I & II. P Singh and RF Moore, eds., Elsevier Science Publishers, Amsterdam and New York, 1985, pp 448). Briefly, a liter diet was made up as follows: 20 g of agar added to 980 ml of Milli-Q water and autoclaved; the agar solution was cooled down to approximately 55 and the remaining ingredients were added and mixed thoroughly: 40 g corn flour (Polenta), 20 g cellulose, 30 g sucrose, 30 g casein, 20 g wheat germ (toasted), 8 g Wesson salt mixture, 12 g Vanderzant vitamin mix, 1.8 g sorbic acid, 1.6 g nipagin (methylparaben), 0.3 g aureomycin, 0.4 g cholesterol and 0.6 g L-cysteine. The diet was cooled down to approx. 45 and poured into rearing trays or cups. The diet was left to set in a horizontal laminair flow cabin. Rice leaf sections with oviposited eggs were removed from a cage housing adult moths and pinned to the solid diet in the rearing cup or tray. Eggs were left to hatch and neonate larvae were available for bioassays and the maintenance of the insect cultures. During the trials and rearings, the conditions were 28±2° C. and 80±5% relative humidity, with a 16:8 hour light:dark photoperiod.

The same artificial diet is used for the bioassays but in this case the diet is poured equally in 24 multiwell plates, with each well containing 1 ml diet. Once the diet is set, the test formulations are applied to the diet's surface (2 $cm^2$), at the rate of 50 μl of 1 μg/μl dsRNA of target. The dsRNA solutions are left to dry and two first instar moth larvae are placed in each well. After 7 days, the larvae are transferred to fresh treated diet in multiwell plates. At day 14 (i.e. 14 days post bioassay start) the number of live and dead insects is recorded and examined for abnormalities. Twenty-four larvae in total are tested per treatment.

An alternative bioassay is performed in which treated rice leaves are fed to neonate larvae of the rice striped stem borer. Small leaf sections of Indica rice variety Taichung native 1 are dipped in 0.05% Triton X-100 solution containing 1 μg/μl of target dsRNA, left to dry and each section placed in a well of a 24 multiwell plate containing gellified 2% agar. Two neonates are transferred from the rearing tray to each dsRNA treated leaf section (24 larvae per treatment). After 4 and 8 days, the larvae are transferred to fresh treated rice leaf sections. The number of live and dead larvae are assessed on days 4, 8 and 12; any abnormalities are also recorded.

D. Cloning of a SSB Gene Fragment in a Vector Suitable for Bacterial Production of Insect-Active Double-Stranded RNA What follows is an example of cloning a DNA fragment corresponding to an SSB gene target in a vector for the expression of double-stranded RNA in a bacterial host, although any vector comprising a T7 promoter or any other promoter for efficient transcription in bacteria, may be used (reference to WO0001846).

The sequences of the specific primers used for the amplification of target genes are provided in Table 8-CS. The template used is the pCR8/GW/topo vector containing any of target sequences. The primers are used in a PCR reaction with the following conditions: 5 minutes at 98° C., followed by 30 cycles of 10 seconds at 98° C., 30 seconds at 55° C. and 2 minutes at 72° C., followed by 10 minutes at 72° C. The resulting PCR fragment is analyzed on agarose gel, purified (QIAquick Gel Extraction kit, Cat. Nr. 28706, Qiagen), blunt-end cloned into Srf I-linearized pGNA49A vector (reference to WO00188121A1), and sequenced. The sequence of the resulting PCR product corresponds to the respective sequence as given in Table 8-CS. The recombinant vector harboring this sequence is named pGXXX0XX.

E. Expression and Production of a Double-Stranded RNA Target in Two Strains of *Escherichia coli*: (1) AB301-105 (DE3), and, (2) BL21(DE3)

The procedures described below are followed in order to express suitable levels of insect-active double-stranded RNA of insect target in bacteria. An RNaseIII-deficient strain, AB301-105(DE3), is used in comparison to wild-type RNaseIII-containing bacteria, BL21(DE3).

Transformation of AB301-105(DE3) and BL21(DE3)

Three hundred ng of the plasmid are added to and gently mixed in a 50 μl aliquot of ice-chilled chemically competent *E. coli* strain AB301-105(DE3) or BL21(DE3). The cells are incubated on ice for 20 minutes before subjecting them to a heat shock treatment of 37° C. for 5 minutes, after which the cells are placed back on ice for a further 5 minutes. Four hundred and fifty μl of room temperature SOC medium is added to the cells and the suspension incubated on a shaker (250 rpm) at 37° C. for 1 hour. One hundred μl of the bacterial cell suspension is transferred to a 500 ml conical flask containing 150 ml of liquid Luria-Bertani (LB) broth supplemented with 100 μg/ml carbenicillin antibiotic. The culture is incubated on an Innova 4430 shaker (250 rpm) at 37° C. overnight (16 to 18 hours).

Chemical Induction of Double-Stranded RNA Expression in AB301-105(DE3) and BL21(DE3)

Expression of double-stranded RNA from the recombinant vector, pGXXX0XX, in the bacterial strain AB301-105 (DE3) or BL21(DE3) is made possible since all the genetic components for controlled expression are present. In the presence of the chemical inducer isopropylthiogalactoside, or IPTG, the T7 polymerase will drive the transcription of the target sequence in both antisense and sense directions since these are flanked by oppositely oriented T7 promoters.

The optical density at 600 nm of the overnight bacterial culture is measured using an appropriate spectrophotometer and adjusted to a value of 1 by the addition of fresh LB broth. Fifty ml of this culture is transferred to a 50 ml Falcon tube and the culture then centrifuged at 3000 g at 15° C. for 10 minutes. The supernatant is removed and the bacterial pellet resuspended in 50 ml of fresh S complete medium (SNC medium plus 5 μg/ml cholesterol) supplemented with 100 μg/ml carbenicillin and 1 mM IPTG. The bacteria are induced for 2 to 4 hours at room temperature.

Heat Treatment of Bacteria

Bacteria are killed by heat treatment in order to minimise the risk of contamination of the artificial diet in the test plates. However, heat treatment of bacteria expressing double-stranded RNA is not a prerequisite for inducing toxicity towards the insects due to RNA interference. The induced bacterial culture is centrifuged at 3000 g at room temperature for 10 minutes, the supernatant discarded and the pellet subjected to 80° C. for 20 minutes in a water bath. After heat treatment, the bacterial pellet is resuspended in 1.5 ml MilliQ water and the suspension transferred to a microfuge tube. Several tubes are prepared and used in the bioassays for each refreshment. The tubes are stored at −20° C. until further use.

F. Laboratory Trials to Test *Escherichia coli* Expressing dsRNA Targets Against *Chilo suppressalis*

Plant-Based Bioassays

Whole plants are sprayed with suspensions of chemically induced bacteria expressing dsRNA prior to feeding the plants to SSB. The are grown from in a plant growth room chamber. The plants are caged by placing a 500 ml plastic bottle upside down over the plant with the neck of the bottle firmly placed in the soil in a pot and the base cut open and covered with a fine nylon mesh to permit aeration, reduce condensation inside and prevent insect escape. SSB are placed on each treated plant in the cage. Plants are treated with a suspension of *E. coli* AB301-105(DE3) harboring the pGXXX0XX plasmids or pGN29 plasmid. Different quantities of bacteria are applied to the plants: for instance 66, 22, and 7 units, where one unit is defined as $10^9$ bacterial cells in 1 ml of a bacterial suspension at optical density value of 1 at 600 nm wavelength. In each case, a total volume of between 1 and 10 ml s sprayed on the plant with the aid of a vaporizer. One plant is used per treatment in this trial. The number of survivors are counted and the weight of each survivor recorded.

Spraying plants with a suspension of *E. coli* bacterial strain AB301-105(DE3) expressing target dsRNA from pGXXX0XX leed to a dramatic increase in insect mortality when compared to pGN29 control. These experiments show that double-stranded RNA corresponding to an insect gene target sequence produced in either wild-type or RNaseIII-deficient bacterial expression systems is toxic towards the insect in terms of substantial increases in insect mortality and growth/development delay for larval survivors. It is also clear from these experiments that an exemplification is provided for the effective protection of plants/crops from insect damage by the use of a spray of a formulation consisting of bacteria expressing double-stranded RNA corresponding to an insect gene target.

Example 11

*Plutella xylostella* (Diamondback Moth)

A. Cloning of a Partial Sequence of the *Plutella xylostella*

High quality, intact RNA was isolated from all the different larval stages of *Plutella xylostella* (Diamondback moth; source: Dr. Lara Senior, Insect Investigations Ltd., Capital Business Park, Wentloog, Cardiff, CF3 2PX, Wales, UK) using TRIzol Reagent (Cat. Nr. 15596-026/15596-018, Invitrogen, Rockville, Md., USA) following the manufacturer's instructions. Genomic DNA present in the RNA preparation was removed by DNase treatment following the manufacturer's instructions (Cat. Nr. 1700, Promega). cDNA was generated using a commercially available kit (SuperScript™ III Reverse Transcriptase, Cat. Nr. 18080044, Invitrogen, Rockville, Md., USA) following the manufacturer's instructions.

To isolate cDNA sequences comprising a portion of the PX001, PX009, PX010, PX015, PX016 genes, a series of PCR reactions with degenerate primers were performed using Amplitaq Gold (Cat. Nr. N8080240, Applied Biosystems) following the manufacturer's instructions.

The sequences of the degenerate primers used for amplification of each of the genes are given in Table 2-PX. These primers were used in respective PCR reactions with the following conditions: 10 minutes at 95° C., followed by 40 cycles of 30 seconds at 95° C., 1 minute at 50° C. and 1 minute and 30 seconds at 72° C., followed by 7 minutes at 72° C. (for PX001, PX009, PX015, PX016); 10 minutes at 95° C., followed by 40 cycles of 30 seconds at 95° C., 1 minute at 54° C. and 2 minute and 30 seconds at 72° C., followed by 7 minutes at 72° C. (for PX010). The resulting PCR fragments were analyzed on agarose gel, purified (QIAquick Gel Extraction kit, Cat. Nr. 28706, Qiagen), cloned into the pCR8/GW/TOPO vector (Cat. Nr. K2500-20, Invitrogen) and sequenced. The sequences of the resulting PCR products are represented by the respective SEQ ID NOs as given in Table 2-PX and are referred to as the partial sequences. The corresponding partial amino acid sequence are represented by the respective SEQ ID NOs as given in Table 3-PX.

B. dsRNA Production of the *Plutella xylostella* Genes dsRNA was synthesized in milligram amounts using the commercially available kit T7 Ribomax™ Express RNAi System (Cat. Nr. P1700, Promega). First two separate single 5' T7 RNA polymerase promoter templates were generated in two separate PCR reactions, each reaction containing the target sequence in a different orientation relative to the T7 promoter.

For each of the target genes, the sense T7 template was generated using specific T7 forward and specific reverse primers. The sequences of the respective primers for amplifying the sense template for each of the target genes are given in Table 8-PX. The conditions in the PCR reactions were as follows: 1 minute at 95° C., followed by 20 cycles of 30 seconds at 95° C., 30 seconds at 60° C. (−0.5° C./cycle) and 1 minute at 72° C., followed by 15 cycles of 30 seconds at 95° C., 30 seconds at 50° C. and 1 minute at 72° C., followed by 10 minutes at 72° C. The anti-sense T7 template was generated using specific forward and specific T7 reverse primers in a PCR reaction with the same conditions as described above. The sequences of the respective primers for amplifying the anti-sense template for each of the target genes are given in Table 8-PX. The resulting PCR products were analyzed on agarose gel and purified by PCR purification kit (Qiaquick PCR Purification Kit, Cat. Nr. 28106, Qiagen) and $NaClO_4$ precipitation. The generated T7 forward and reverse templates were mixed to be transcribed and the resulting RNA strands were annealed, DNase and RNase treated, and purified by sodium acetate, following the manufacturer's instructions. The sense strand of the resulting dsRNA for each of the target genes is given in Table 8-PX.

C. Laboratory Trials to Test dsRNA Targets, Using Artificial Diet for Activity Against *Plutella xylostella* Larvae Diamond-back moths, *Plutella xylostella*, were maintained at Insect Investigations Ltd. (origin: Newcastle University, Newcastle-upon-Tyne, UK). The insects were reared on cabbage leaves. First instar, mixed sex larvae (approximately 1 day old) were selected for use in the trial. Insects were maintained in Eppendorf tubes (1.5 ml capacity). Commercially available Diamond-back moth diet (Bio-Serv, NJ, USA), prepared following the manafacturer's instructions, was placed in the lid of each tube (0.25 ml capacity, 8 mm diameter). While still liquid, the diet was smoother over to remove excess and produce an even surface.

Once the diet has set the test formulations are applied to the diets surface, at the rate of 25 µl undiluted formulation (1 µg/µl dsRNA of targets) per replicate. The test formulations are allowed to dry and one first instar moth larva is placed in each tube. The larva is placed on the surface of the diet in the lid and the tube carefully closed. The tubes are stored upside down, on their lids such that each larva remains on the surface of the diet. Twice weekly the larvae are transferred to new Eppendorf tubes with fresh diet. The insects are provided with treated diet for the first two weeks of the trial and thereafter with untreated diet.

Assessments are made twice weekly for a total of 38 days at which point all larvae are dead. At each assessment the insects are assessed as live or dead and examined for abnormalities. Forty single larva replicates are performed for each of the treatments. During the trial the test conditions are 23 to 26° C. and 50 to 65% relative humidity, with a 16:8 hour light:dark photoperiod.

D. Cloning of a DBM Gene Fragment in a Vector Suitable for Bacterial Production of Insect-Active Double-Stranded RNA What follows is an example of cloning a DNA fragment corresponding to a DBM gene target in a vector for the expression of double-stranded RNA in a bacterial host, although any vector comprising a T7 promoter or any other promoter for efficient transcription in bacteria, may be used (reference to WO0001846).

The sequences of the specific primers used for the amplification of target genes are provided in Table 8-PX. The template used is the pCR8/GW/topo vector containing any of target sequences. The primers are used in a PCR reaction with the following conditions: 5 minutes at 98° C., followed by 30 cycles of 10 seconds at 98° C., 30 seconds at 55° C. and 2 minutes at 72° C., followed by 10 minutes at 72° C. The resulting PCR fragment is analyzed on agarose gel, purified (QIAquick Gel Extraction kit, Cat. Nr. 28706, Qiagen), blunt-end cloned into Srf I-linearized pGNA49A vector (reference to WO00188121A1), and sequenced. The sequence of the resulting PCR product corresponds to the respective sequence as given in Table 8-PX. The recombinant vector harboring this sequence is named pGXXX0XX.

E. Expression and Production of a Double-Stranded RNA Target in Two Strains of *Escherichia coli*: (1) AB301-105 (DE3), and, (2) BL21(DE3)

The procedures described below are followed in order to express suitable levels of insect-active double-stranded RNA of insect target in bacteria. An RNaseIII-deficient strain, AB301-105(DE3), is used in comparison to wild-type RNaseIII-containing bacteria, BL21(DE3).

Transformation of AB301-105(DE3) and BL21(DE3)

Three hundred ng of the plasmid are added to and gently mixed in a 50 μl aliquot of ice-chilled chemically competent *E. coli* strain AB301-105(DE3) or BL21(DE3). The cells are incubated on ice for 20 minutes before subjecting them to a heat shock treatment of 37° C. for 5 minutes, after which the cells are placed back on ice for a further 5 minutes. Four hundred and fifty μl of room temperature SOC medium is added to the cells and the suspension incubated on a shaker (250 rpm) at 37° C. for 1 hour. One hundred μl of the bacterial cell suspension is transferred to a 500 ml conical flask containing 150 ml of liquid Luria-Bertani (LB) broth supplemented with 100 μg/ml carbenicillin antibiotic. The culture is incubated on an Innova 4430 shaker (250 rpm) at 37° C. overnight (16 to 18 hours).

Chemical Induction of Double-Stranded RNA Expression in AB301-105(DE3) and BL21(DE3)

Expression of double-stranded RNA from the recombinant vector, pGXXX0XX, in the bacterial strain AB301-105 (DE3) or BL21(DE3) is made possible since all the genetic components for controlled expression are present. In the presence of the chemical inducer isopropylthiogalactoside, or IPTG, the T7 polymerase will drive the transcription of the target sequence in both antisense and sense directions since these are flanked by oppositely oriented T7 promoters.

The optical density at 600 nm of the overnight bacterial culture is measured using an appropriate spectrophotometer and adjusted to a value of 1 by the addition of fresh LB broth. Fifty ml of this culture is transferred to a 50 ml Falcon tube and the culture then centrifuged at 3000 g at 15° C. for 10 minutes. The supernatant is removed and the bacterial pellet resuspended in 50 ml of fresh S complete medium (SNC medium plus 5 μg/ml cholesterol) supplemented with 100 μg/ml carbenicillin and 1 mM IPTG. The bacteria are induced for 2 to 4 hours at room temperature.

Heat Treatment of Bacteria

Bacteria are killed by heat treatment in order to minimise the risk of contamination of the artificial diet in the test plates. However, heat treatment of bacteria expressing double-stranded RNA is not a prerequisite for inducing toxicity towards the insects due to RNA interference. The induced bacterial culture is centrifuged at 3000 g at room temperature for 10 minutes, the supernatant discarded and the pellet subjected to 80° C. for 20 minutes in a water bath. After heat treatment, the bacterial pellet is resuspended in 1.5 ml MilliQ water and the suspension transferred to a microfuge tube. Several tubes are prepared and used in the bioassays for each refreshment. The tubes are stored at −20° C. until further use.

F. Laboratory Trials to Test *Escherichia coli* Expressing dsRNA Targets Against *Plutella xylostella*

Plant-Based Bioassays

Whole plants are sprayed with suspensions of chemically induced bacteria expressing dsRNA prior to feeding the plants to DBM. The are grown from in a plant growth room chamber. The plants are caged by placing a 500 ml plastic bottle upside down over the plant with the neck of the bottle firmly placed in the soil in a pot and the base cut open and covered with a fine nylon mesh to permit aeration, reduce condensation inside and prevent insect escape. DBM are placed on each treated plant in the cage. Plants are treated with a suspension of *E. coli* AB301-105(DE3) harboring the pGXXX0XX plasmids or pGN29 plasmid. Different quantities of bacteria are applied to the plants: for instance 66, 22, and 7 units, where one unit is defined as $10^9$ bacterial cells in 1 ml of a bacterial suspension at optical density value of 1 at 600 nm wavelength. In each case, a total volume of between 1 and 10 ml s sprayed on the plant with the aid of a vaporizer. One plant is used per treatment in this trial. The number of survivors are counted and the weight of each survivor recorded.

Spraying plants with a suspension of *E. coli* bacterial strain AB301-105(DE3) expressing target dsRNA from pGXXX0XX leed to a dramatic increase in insect mortality when compared to pGN29 control. These experiments show that double-stranded RNA corresponding to an insect gene target sequence produced in either wild-type or RNaseIII-deficient bacterial expression systems is toxic towards the insect in terms of substantial increases in insect mortality and growth/development delay for larval survivors. It is also clear from these experiments that an exemplification is provided for the effective protection of plants/crops from insect damage by the use of a spray of a formulation consisting of bacteria expressing double-stranded RNA corresponding to an insect gene target.

Example 12

*Acheta domesticus* (House Cricket)

A. Cloning *Acheta domesticus* Partial Sequences

High quality, intact RNA was isolated from all the different insect stages of *Acheta domesticus* (house cricket; source: Dr. Lara Senior, Insect Investigations Ltd., Capital Business Park, Wentloog, Cardiff, CF3 2PX, Wales, UK) using TRIzol Reagent (Cat. Nr. 15596-026/15596-018, Invitrogen, Rockville, Md., USA) following the manufacturer's instructions. Genomic DNA present in the RNA preparation was removed by DNase treatment following the manafacturer's instructions (Cat. Nr. 1700, Promega). cDNA was generated using a commercially available kit (SuperScript™ III Reverse Transcriptase, Cat. Nr. 18080044, Invitrogen, Rockville, Md., USA) following the manufacturer's instructions.

To isolate cDNA sequences comprising a portion of the AD001, AD002, AD009, AD015 and AD016 genes, a series of PCR reactions with degenerate primers were performed using Amplitaq Gold (Cat. Nr. N8080240, Applied Biosystems) following the manufacturer's instructions.

The sequences of the degenerate primers used for amplification of each of the genes are given in Table 2-AD. These primers were used in respective PCR reactions with the following conditions: 10 minutes at 95° C., followed by 40 cycles of 30 seconds at 95° C., 1 minute at 50° C. and 1 minute and 30 seconds at 72° C., followed by 7 minutes at 72° C. The resulting PCR fragments were analyzed on agarose gel, purified (QIAquick Gel Extraction kit, Cat. Nr. 28706, Qiagen), cloned into the pCR8/GW/topo vector (Cat. Nr. K2500 20, Invitrogen) and sequenced. The sequences of the resulting PCR products are represented by the respective SEQ ID NOs as given in Table 2-AD and are referred to as the partial sequences. The corresponding partial amino acid sequence are represented by the respective SEQ ID NOs as given in Table 3-AD.

B. dsRNA Production of the *Acheta domesticus* Genes dsRNA was synthesized in milligram amounts using the commercially available kit T7 Ribomax™ Express RNAi System (Cat. Nr. P1700, Promega). First two separate single 5' T7 RNA polymerase promoter templates were generated in two separate PCR reactions, each reaction containing the target sequence in a different orientation relative to the T7 promoter.

For each of the target genes, the sense T7 template was generated using specific T7 forward and specific reverse primers. The sequences of the respective primers for amplifying the sense template for each of the target genes are given in Table 8-AD. The conditions in the PCR reactions were as follows: 1 minute at 95° C., followed by 20 cycles of 30 seconds at 95° C., 30 seconds at 60° C. (−0.5° C./cycle) and 1 minute at 72° C., followed by 15 cycles of 30 seconds at 95° C., 30 seconds at 50° C. and 1 minute at 72° C., followed by 10 minutes at 72° C. The anti-sense T7 template was generated using specific forward and specific T7 reverse primers in a PCR reaction with the same conditions as described above. The sequences of the respective primers for amplifying the anti-sense template for each of the target genes are given in Table 8-AD. The resulting PCR products were analyzed on agarose gel and purified by PCR purification kit (Qiaquick PCR Purification Kit, Cat. Nr. 28106, Qiagen) and NaClO$_4$ precipitation. The generated T7 forward and reverse templates were mixed to be transcribed and the resulting RNA strands were annealed, DNase and RNase treated, and purified by sodium acetate, following the manufacturer's instructions. The sense strand of the resulting dsRNA for each of the target genes is given in Table 8-AD.

C. Laboratory Trials to Test dsRNA Targets, Using Artificial Diet for Activity Against *Acheta domesticus* Larvae House crickets, *Acheta domesticus*, were maintained at Insect Investigations Ltd. (origin: Blades Biological Ltd., Kent, UK). The insects were reared on bran pellets and cabbage leaves. Mixed sex nymphs of equal size and no more than 5 days old were selected for use in the trial. Double-stranded RNA is mixed with a wheat-based pelleted rodent diet (rat and mouse standard diet, B & K Universal Ltd., Grimston, Aldbrough, Hull, UK). The diet, BK001 P, contains the following ingredients in descending order by weight: wheat, soya, wheatfeed, barley, pellet binder, rodent 5 vit min, fat blend, dicalcium phosphate, mould carb. The pelleted rodent diet is finely ground and heat-treated in a microwave oven prior to mixing, in order to inactivate any enzyme components. All rodent diet is taken from the same batch in order to ensure consistency. The ground diet and dsRNA are mixed thoroughly and formed into small pellets of equal weight, which are allowed to dry overnight at room temperature.

Double-stranded RNA samples from targets and gfp control at concentrations 10 µg/µl were applied in the ratio 1 g ground diet plus 1 ml dsRNA solution, thereby resulting in an application rate of 10 mg dsRNA per g pellet. Pellets are replaced weekly. The insects are provided with treated pellets for the first three weeks of the trial. Thereafter untreated pellets are provided. Insects are maintained within lidded plastic containers (9 cm diameter, 4.5 cm deep), ten per container. Each arena contains one treated bait pellet and one water source (damp cotton wool ball), each placed in a separate small weigh boat. The water is replenished ad lib throughout the experiment.

Assessments are made at twice weekly intervals, with no more than four days between assessments, until all the control insects had either died or moulted to the adult stage (84 days). At each assessment the insects are assessed as live or dead, and examined for abnormalities. From day 46 onwards, once moulting to adult has commenced, all insects (live and dead) are assessed as nymph or adult. Surviving insects are weighed on day 55 of the trial. Four replicates are performed for each of the treatments. During the trial the test conditions are 25 to 33° C. and 20 to 25% relative humidity, with a 12:12 hour light:dark photoperiod.

D. Cloning of a HC Gene Fragment in a Vector Suitable for Bacterial Production of Insect-Active Double-Stranded RNA What follows is an example of cloning a DNA fragment corresponding to a HC gene target in a vector for the expression of double-stranded RNA in a bacterial host, although any vector comprising a T7 promoter or any other promoter for efficient transcription in bacteria, may be used (reference to WO0001846).

The sequences of the specific primers used for the amplification of target genes are provided in Table 8-AD. The template used is the pCR8/GW/topo vector containing any of target sequences. The primers are used in a PCR reaction with the following conditions: 5 minutes at 98° C., followed by 30 cycles of 10 seconds at 98° C., 30 seconds at 55° C. and 2 minutes at 72° C., followed by 10 minutes at 72° C. The resulting PCR fragment is analyzed on agarose gel, purified (QIAquick Gel Extraction kit, Cat. Nr. 28706, Qiagen), blunt-end cloned into Srf I-linearized pGNA49A vector (reference to WO00188121A1), and sequenced. The sequence of the resulting PCR product corresponds to the respective sequence as given in Table 8-AD. The recombinant vector harboring this sequence is named pGXXX0XX.

E. Expression and Production of a Double-Stranded RNA Target in Two Strains of *Escherichia coli*: (1) AB301-105 (DE3), and, (2) BL21(DE3)

The procedures described below are followed in order to express suitable levels of insect-active double-stranded RNA of insect target in bacteria. An RNaseIII-deficient strain, AB301-105(DE3), is used in comparison to wild-type RNaseIII-containing bacteria, BL21(DE3).

Transformation of AB301-105(DE3) and BL21(DE3)

Three hundred ng of the plasmid are added to and gently mixed in a 50 µl aliquot of ice-chilled chemically competent *E. coli* strain AB301-105(DE3) or BL21(DE3). The cells are incubated on ice for 20 minutes before subjecting them to a heat shock treatment of 37° C. for 5 minutes, after which the cells are placed back on ice for a further 5 minutes. Four hundred and fifty µl of room temperature SOC medium is added to the cells and the suspension incubated on a shaker (250 rpm) at 37° C. for 1 hour. One hundred µl of the bacterial cell suspension is transferred to a 500 ml conical flask containing 150 ml of liquid Luria-Bertani (LB) broth supplemented with 100 µg/ml carbenicillin antibiotic. The culture is incubated on an Innova 4430 shaker (250 rpm) at 37° C. overnight (16 to 18 hours).

Chemical Induction of Double-Stranded RNA Expression in AB301-105(DE3) and BL21(DE3)

Expression of double-stranded RNA from the recombinant vector, pGXXX0XX, in the bacterial strain AB301-105 (DE3) or BL21(DE3) is made possible since all the genetic components for controlled expression are present. In the presence of the chemical inducer isopropylthiogalactoside, or IPTG, the T7 polymerase will drive the transcription of the target sequence in both antisense and sense directions since these are flanked by oppositely oriented T7 promoters.

The optical density at 600 nm of the overnight bacterial culture is measured using an appropriate spectrophotometer and adjusted to a value of 1 by the addition of fresh LB broth.

Fifty ml of this culture is transferred to a 50 ml Falcon tube and the culture then centrifuged at 3000 g at 15° C. for 10 minutes. The supernatant is removed and the bacterial pellet resuspended in 50 ml of fresh S complete medium (SNC medium plus 5 µg/ml cholesterol) supplemented with 100 µg/ml carbenicillin and 1 mM IPTG. The bacteria are induced for 2 to 4 hours at room temperature.

Heat Treatment of Bacteria

Bacteria are killed by heat treatment in order to minimise the risk of contamination of the artificial diet in the test plates. However, heat treatment of bacteria expressing double-stranded RNA is not a prerequisite for inducing toxicity towards the insects due to RNA interference. The induced bacterial culture is centrifuged at 3000 g at room temperature for 10 minutes, the supernatant discarded and the pellet subjected to 80° C. for 20 minutes in a water bath. After heat treatment, the bacterial pellet is resuspended in 1.5 ml MilliQ water and the suspension transferred to a microfuge tube. Several tubes are prepared and used in the bioassays for each refreshment. The tubes are stored at −20° C. until further use.

F. Laboratory Trials to Test *Escherichia coli* Expressing dsRNA Targets Against *Acheta domesticus*

Plant-Based Bioassays

Whole plants are sprayed with suspensions of chemically induced bacteria expressing dsRNA prior to feeding the plants to HC. The are grown from in a plant growth room chamber. The plants are caged by placing a 500 ml plastic bottle upside down over the plant with the neck of the bottle firmly placed in the soil in a pot and the base cut open and covered with a fine nylon mesh to permit aeration, reduce condensation inside and prevent insect escape. HC are placed on each treated plant in the cage. Plants are treated with a suspension of *E. coli* AB301-105(DE3) harboring the pGXXX0XX plasmids or pGN29 plasmid. Different quantities of bacteria are applied to the plants: for instance 66, 22, and 7 units, where one unit is defined as $10^9$ bacterial cells in 1 ml of a bacterial suspension at optical density value of 1 at 600 nm wavelength. In each case, a total volume of between 1 and 10 ml s sprayed on the plant with the aid of a vaporizer. One plant is used per treatment in this trial. The number of survivors are counted and the weight of each survivor recorded.

Spraying plants with a suspension of *E. coli* bacterial strain AB301-105(DE3) expressing target dsRNA from pGXXX0XX leads to a dramatic increase in insect mortality when compared to pGN29 control. These experiments show that double-stranded RNA corresponding to an insect gene target sequence produced in either wild-type or RNaseIII-deficient bacterial expression systems is toxic towards the insect in terms of substantial increases in insect mortality and growth/development delay for larval survivors. It is also clear from these experiments that an exemplification is provided for the effective protection of plants/crops from insect damage by the use of a spray of a formulation consisting of bacteria expressing double-stranded RNA corresponding to an insect gene target.

TABLE 1A

| C. elegans ID | D. melanogaster ID | Description | Devgen RNAi screen |
|---|---|---|---|
| B0250.1 | CG1263 | large ribosomal subunit L8 protein. | Acute lethal or lethal |
| B0336.10 | CG3661 | large ribosomal subunit L23 protein. | Acute lethal or lethal |
| B0336.2 | CG8385 | ADP-ribosylation factor | Acute lethal or lethal |
| B0464.1 | CG3821 | Putative aspartyl(D) tRNA synthetase. | Acute lethal or lethal |
| C01G8.5 | CG10701 | Ortholog of the ERM family of cytoskeletal linkers | Acute lethal or lethal |
| C01H6.5 | CG33183 | Nuclear hormone receptor that is required in all larval molts | Acute lethal or lethal |
| C02C6.1 | CG18102 | Member of the DYNamin related gene class | Acute lethal or lethal |
| C03D6.8 | CG6764 | Large ribosomal subunit L24 protein (Rlp24p) | Acute lethal or lethal |
| C04F12.4 | CG6253 | rpl-14 encodes a large ribosomal subunit L14 protein. | Acute lethal or lethal |
| C04H5.6 | CG10689 | Product with RNA helicase activity (EC: 2.7.7.—) involved in nuclear mRNA splicing, via spliceosome which is a component of the spliceosome complex | Embryonic lethal or sterile |
| C13B9.3 | CG14813 | Delta subunit of the coatomer (COPI) complex | Acute lethal or lethal |
| C17H12.14 | CG1088 | Member of the Vacuolar H ATPase gene class | Acute lethal or lethal |
| C26E6.4 | CG3180 | DNA-directed RNA polymerase II | Acute lethal or lethal |
| F23F12.6 | CG16916 | Triple A ATPase subunit of the 26S proteasome's 19S regulatory particle (RP) base subcomplex | Acute lethal or lethal |
| F57B9.10 | CG10149 | Member of the proteasome Regulatory Particle, Non-ATPase-like gene class | Acute lethal or lethal |
| K11D9.2 | CG3725 | sarco-endoplasmic reticulum Ca[2+] ATPase homolog | Embryonic lethal or sterile |
| T20G5.1 | CG9012 | Clathrin heavy chain | Acute lethal or lethal |
| T20H4.3 | CG5394 | Predicted cytoplasmic prolyl-tRNA synthetase (ProRS) | Acute lethal or lethal |
| T21E12.4 | CG7507 | Cytoplasmic dynein heavy chain homolog | Acute lethal or lethal |
| C05C10.3 | CG1140 | Orthologue to the human gene 3-OXOACID COA TRANSFERASE | Acute lethal or lethal |
| C09D4.5 | CG2746 | Ribosomal protein L19, structural constituent of ribosome involved in protein biosynthesis which is localised to the ribosome | Acute lethal or lethal |
| C09E10.2 | CG31140 | Orthologue of diacylglycerol kinase involved in movement, egg laying, and synaptic transmission, and is expressed in neurons. | Acute lethal or lethal |
| C13B9.3 | CG14813 | Delta subunit of the coatomer (COPI) | Acute lethal or lethal |
| C14B9.7 | CG12775 | Large ribosomal subunit L21 protein (RPL-21) involved in protein biosynthesis | Acute lethal or lethal |

TABLE 1A-continued

| C. elegans ID | D. melanogaster ID | Description | Devgen RNAi screen |
|---|---|---|---|
| C15H11.7 | CG30382 | Type 6 alpha subunit of the 26S proteasome's 20S protease core particle (CP) | Acute lethal or lethal |
| C17E4.9 | CG9261 | Protein involved with Na+/K+-exchanging ATPase complex | Embryonic lethal or sterile |
| C17H12.14 | CG1088 | V-ATPase E subunit | Acute lethal or lethal |
| C23G10.4 | CG11888 | Non-ATPase subunit of the 26S proteasome's 19S regulatory paritcle base subcomplex (RPN-2) | Acute lethal or lethal |
| C26D10.2 | CG7269 | Product with helicase activity involved in nuclear mRNA splicing, via spliceosome which is localized to the nucleus | Acute lethal or lethal |
| C26E6.4 | CG3180 | RNA polymerase II 140 kD subunit (RpII140), DNA-directed RNA polymerase activity (EC: 2.7.7.6) involved in transcription from Pol II promoter which is a component of the DNA-directed RNA polymerase II, core complex | Acute lethal or lethal |
| C26F1.4 | CG15697 | Product with function in protein biosynthesis and ubiquitin in protein degradation. | Acute lethal or lethal |
| C30C11.1 | CG12220 | Unknown function | Acute lethal or lethal |
| C30C11.2 | CG10484 | Member of the proteasome Regulatory Particle, Non-ATPase-like gene class | Acute lethal or lethal |
| C36A4.2 | CG13977 | cytochrome P450 | Acute lethal or lethal |
| C37C3.6 | CG33103 | Orthologous to thrombospondin, papilin and lacunin | Acute lethal or lethal |
| C37H5.8 | CG8542 | Member of the Heat Shock Protein gene class | Acute lethal or lethal |
| C39F7.4 | CG3320 | Rab-protein 1 involved in cell adhesion | Acute lethal or lethal |
| C41C4.8 | CG2331 | Transitional endoplasmic reticulum ATPase TER94, Golgi organization and biogenesis | Growth delay or arrested in growth |
| C42D8.5 | CG8827 | ACE-like protein | Acute lethal or lethal |
| C47E12.5 | CG1782 | Ubiquitin-activating enzyme, function in an ATP-dependent reaction that activates ubiquitin prior to its conjugation to proteins that will subsequently be degraded by the 26S proteasome. | Acute lethal or lethal |
| C47E8.5 | CG1242 | Member of the abnormal DAuer Formation gene class | Acute lethal or lethal |
| C49H3.11 | CG5920 | Small ribosomal subunit S2 protein. | Acute lethal or lethal |
| C52E4.4 | CG1341 | Member of the proteasome Regulatory Particle, ATPase-like gene class | Acute lethal or lethal |
| C56C10.3 | CG8055 | Carrier protein with putatively involved in intracellular protein transport | Growth delay or arrested in growth |
| CD4.6 | CG4904 | Type 1 alpha subunit of the 26S proteasome's 20S protease core particle (CP). | Acute lethal or lethal |
| D1007.12 | CG9282 | Large ribosomal subunit L24 protein. | Acute lethal or lethal |
| D1054.2 | CG5266 | Member of the Proteasome Alpha Subunit gene class | Acute lethal or lethal |
| D1081.8 | CG6905 | MYB transforming protein | Acute lethal or lethal |
| F07D10.1 | CG7726 | Large ribosomal subunit L11 protein (RPL-11.2) involved in protein biosynthesis. | Acute lethal or lethal |
| F11C3.3 | CG17927 | Muscle myosin heavy chain (MHC B) | Acute lethal or lethal |
| F13H10.2 | CG4863 | Large ribosomal subunit L3 protein (rpl-3) | Acute lethal or lethal |
| F16A11.2 | CG9987 | Methanococcus hypothetical protein 0682 like | Acute lethal or lethal |
| F20B6.2 | CG17369 | V-ATPase B subunit | Growth delay or arrested in growth |
| F23F12.6 | CG16916 | Triple A ATPase subunit of the 26S proteasome's 19S regulatory particle (RP) base subcomplex (RPT-3) | Acute lethal or lethal |
| F25H5.4 | CG2238 | Translation elongation factor 2 (EF-2), a GTP-binding protein involved in protein synthesis | Growth delay or arrested in growth |
| F26D10.3 | CG4264 | Member of the Heat Shock Protein gene class | Acute lethal or lethal |
| F28C6.7 | CG6846 | Large ribosomal subunit L26 protein (RPL-26) involved in protein biosynthesis | Embryonic lethal or sterile |
| F28D1.7 | CG8415 | Small ribosomal subunit S23 protein (RPS-23) involved in protein biosynthesis | Acute lethal or lethal |
| F29G9.5 | CG5289 | Member of the proteasome Regulatory Particle, ATPase-like gene class | Acute lethal or lethal |
| F32H2.5 | CG3523 | Mitochondrial protein | Acute lethal or lethal |
| F37C12.11 | CG2986 | Small ribosomal subunit S21 protein (RPS-21) involved in protein biosynthesis | Acute lethal or lethal |
| F37C12.4 | CG7622 | Large ribosomal subunit L36 protein (RPL-36) involved in protein biosynthesis | Acute lethal or lethal |
| F37C12.9 | CG1527 | Small ribosomal subunit S14 protein (RPS-14) involved in protein biosynthesis | Acute lethal or lethal |
| F38E11.5 | CG6699 | beta' (beta-prime) subunit of the coatomer (COPI) complex | Acute lethal or lethal |
| F39B2.6 | CG10305 | Small ribosomal subunit S26 protein (RPS-26) involved in protein biosynthesis | Acute lethal or lethal |

TABLE 1A-continued

| C. elegans ID | D. melanogaster ID | Description | Devgen RNAi screen |
|---|---|---|---|
| F39H11.5 | CG12000 | Member of the Proteasome Beta Subunit gene class | Acute lethal or lethal |
| F40F8.10 | CG3395 | Ribosomal protein S9 (RpS9), structural constituent of ribosome involved in protein biosynthesis which is a component of the cytosolic small ribosomal subunit | Acute lethal or lethal |
| F42C5.8 | CG7808 | Small ribosomal subunit S8 protein (RPS-8) involved in protein biosynthesis | Acute lethal or lethal |
| F49C12.8 | CG5378 | Member of the proteasome Regulatory Particle, Non-ATPase-like gene class | Acute lethal or lethal |
| F53A3.3 | CG2033 | Small ribosomal subunit S15a protein. | Acute lethal or lethal |
| F53G12.10 | CG4897 | large ribosomal subunit L7 protein (rpl-7) | Acute lethal or lethal |
| F54A3.3 | CG8977 | Unknown function | Acute lethal or lethal |
| F54E2.3 | CG1915 | Product with sallimus (sls), myosin-light-chain kinase activity (EC: 2.7.1.117) involved in mitotic chromosome condensation which is localized to the nucleus | |
| F54E7.2 | CG11271 | Small ribosomal subunit S12 protein (RPS-12) involved in protein biosynthesis | Acute lethal or lethal |
| F55A11.2 | CG4214 | Member of the SYNtaxin gene class | Acute lethal or lethal |
| F55A3.3 | CG1828 | transcritpion factor | Acute lethal or lethal |
| F55C10.1 | CG11217 | Ortholog of calcineurin B, the regulatory subunit of the protein phosphatase 2B | Acute lethal or lethal |
| F56F3.5 | CG2168 | rps-1 encodes a small ribosomal subunit S3A protein. | Acute lethal or lethal |
| F57B9.10 | CG10149 | Member of the proteasome Regulatory Particle, Non-ATPase-like gene class | Acute lethal or lethal |
| F58F12.1 | CG2968 | ATP synthase | Acute lethal or lethal |
| F59E10.3 | CG3948 | Zeta subunit of the coatomer (COPI) complex | Acute lethal or lethal |
| JC8.3 | CG3195 | Large ribosomal subunit L12 protein (rpl-12) | Acute lethal or lethal |
| K01G5.4 | CG1404 | Putative RAN small monomeric GTPase (cell adhesion) | Acute lethal or lethal |
| K04F10.4 | CG18734 | Subtilase | Acute lethal or lethal |
| K05C4.1 | CG12323 | Member of the Proteasome Beta Subunit gene class | Acute lethal or lethal |
| K07D4.3 | CG18174 | Putative proteasome regulatory particle, lid subcomplex, rpn11 | Acute lethal or lethal |
| K11D9.2 | CG3725 | Sarco-endoplasmic reticulum Ca[2+] ATPase | Embryonic lethal or sterile; Acute lethal or lethal |
| M03F4.2 | CG4027 | An actin that is expressed in body wall and vulval muscles and the spermatheca. | Acute lethal or lethal |
| R06A4.9 | CG1109 | six WD40 repeats | Acute lethal or lethal |
| R10E11.1 | CG15319 | Putative transcriptional cofactor | Acute lethal or lethal |
| R12E2.3 | CG3416 | Protein with endopeptidase activity involved in proteolysis and peptidolysis | Acute lethal or lethal |
| F10C1.2 | CG10119 | Member of the Intermediate Filament, B gene class | Embryonic lethal or sterile |
| F35G12.8 | CG11397 | Homolog of the SMC4 subunit of mitotic condensin | Embryonic lethal or sterile |
| F53G12.1 | CG5771 | GTPase homologue | Embryonic lethal or sterile |
| F54E7.3 | CG5055 | PDZ domain-containing protein | Embryonic lethal or sterile |
| H28O16.1 | CG3612 | ATP synthase | Growth delay or arrested in growth |
| K12C11.2 | CG4494 | Member of the SUMO (ubiquitin-related) homolog gene class | Embryonic lethal or sterile |
| R12E2.3 | CG3416 | Member of the proteasome Regulatory Particle, Non-ATPase-like gene class | Acute lethal or lethal |
| R13A5.8 | CG6141 | Ribosomal protein L9, structural constituent of ribosome involved in protein biosynthesis which is localised to the ribosome | Acute lethal or lethal |
| T01C3.6 | CG4046 | rps-16 encodes a small ribosomal subunit S16 protein. | Acute lethal or lethal |
| T01H3.1 | CG7007 | proteolipid protein PPA1 like protein | Acute lethal or lethal |
| T05C12.7 | CG5374 | Cytosolic chaperonin | Acute lethal or lethal |
| T05H4.6 | CG5605 | eukaryotic peptide chain release factor subunit 1 | Acute lethal or lethal |
| T10H9.4 | CG17248 | N-synaptobrevin; v-SNARE, vesicle-mediated transport, synaptic vesicle | |
| T14F9.1 | CG17332 | ATPase subunit | Growth delay or arrested in growth |
| T20G5.1 | CG9012 | Clathrin heavy chain | Acute lethal or lethal |
| T21B10.7 | CG7033 | t-complex protein 1 | Embryonic lethal or sterile |
| W09B12.1 | CG17907 | Acetylcholineesterase | |

TABLE 1A-continued

| C. elegans ID | D. melanogaster ID | Description | Devgen RNAi screen |
|---|---|---|---|
| T27F2.1 | CG8264 | Member of the mammalian SKIP (Ski interacting protein) homolog gene class | Acute lethal or lethal |
| ZC434.5 | CG5394 | predicted mitochondrial glutamyl-tRNA synthetase (GluRS) | Acute lethal or lethal |
| B0511.6 | CG6375 | helicase | Embryonic lethal or sterile |
| DY3.2 | CG10119 | Nuclear lamin; LMN-1 protein | Growth delay or arrested in growth |
| R13G10.1 | CG11397 | homolog of the SMC4 subunit of mitotic condensin | Wild Type |
| T26E3.7 | CG3612 | Predicted mitochondrial protein. | Growth delay or arrested in growth |
| Y113G7A.3 | CG1250 | GTPase activator, ER to Golgi prot transport, component of the Golgi stack | Acute lethal or lethal |
| Y43B11AR.4 | CG11276 | Ribosomal protein S4 (RpS4), structural constituent of ribosome involved in protein biosynthesis which is a component of the cytosolic small ribosomal subunit | Acute lethal or lethal |
| Y46G5A.4 | CG5931 | Y46G5A.4 gene | Acute lethal or lethal |
| Y71F9AL.17 | CG7961 | Alpha subunit of the coatomer (COPI) complex | Acute lethal or lethal |
| Y76B12C.7 | CG10110 | Gene cleavage and polyadenylation specificity factor | Embryonic lethal or sterile |
| Y37D8A.10 | CG1751 | Unknown function | Embryonic lethal or sterile |
| CG7765 | C06G3.2 | Member of the Kinesin-Like Protein gene class | |
| CG10922 | C44E4.4 | RNA-binding protein | Embryonic lethal or sterile |
| CG4145 | F01G12.5 | alpha-2 type IV collagen | Embryonic lethal or sterile |
| CG13391 | F28H1.3 | apredicted cytoplasmic alanyl-tRNA synthetase (AlaRS) | Growth delay or arrested in growth |
| CG7765 | R05D3.7 | Member of the UNCoordinated gene class | Embryonic lethal or sterile |
| CG7398 | R06A4.4 | Member of the IMportin Beta family gene class | Embryonic lethal or sterile |
| CG7436 | T17E9.2 | Unknown function | Embryonic lethal or sterile |
| CG2666 | T25G3.2 | putative chitin synthase | Embryonic lethal or sterile |
| CG17603 | W04A8.7 | TATA-binding protein associated factor TAF1L (TAFII250) | Embryonic lethal or sterile |

TABLES 1

LD/PC/EV/AG/TC/MP/NL/PX

| Target ID | Dm identifier | SEQ ID NO NA | SEQ ID NO AA | Function (based on Flybase) |
|---|---|---|---|---|
| LD010 | CG1250 | 11 | 12 | GTPase activator, ER to Golgi protein transport, component of the Golgi stack |
| PC010 | CG1250 | 253 | 254 | |
| EV010 | CG1250 | 517 | 518 | |
| AG010 | CG1250 | 605 | 606 | |
| TC010 | CG1250 | 797 | 798 | |
| MP010 | CG1250 | 892 | 893 | |
| NL010 | CG1250 | 1089 | 1090 | |
| PX010 | CG1250 | 2104 | 2105 | |

TABLE 2

LD

| Target ID | Primer Forward 5' → 3' | Primer Reverse 5' → 3' | cDNA Sequence (sense strand) 5' → 3' |
|---|---|---|---|
| LD001 | SEQ ID NO: 25 | SEQ ID NO: 26 | SEQ ID NO: 1 |
| LD002 | SEQ ID NO: 27 | SEQ ID NO: 28 | SEQ ID NO: 3 |
| LD003 | SEQ ID NO: 29 | SEQ ID NO: 30 | SEQ ID NO: 5 |
| LD006 | SEQ ID NO: 31 | SEQ ID NO: 32 | SEQ ID NO: 7 |
| LD007 | SEQ ID NO: 33 | SEQ ID NO: 34 | SEQ ID NO: 9 |
| LD010 | SEQ ID NO: 35 | SEQ ID NO: 36 | SEQ ID NO: 11 |

TABLE 2-continued

LD

| Target ID | Primer Forward 5' → 3' | Primer Reverse 5' → 3' | cDNA Sequence (sense strand) 5' → 3' |
|---|---|---|---|
| LD011 | SEQ ID NO: 37 | SEQ ID NO: 38 | SEQ ID NO: 13 |
| LD014 | SEQ ID NO: 39 | SEQ ID NO: 40 | SEQ ID NO: 15 |
| LD014_F1 | | | SEQ ID NO: 159 |
| LD014_F2 | | | SEQ ID NO: 160 |
| LD014_C1 | | | SEQ ID NO: 161 |
| LD014_C2 | | | SEQ ID NO: 162 |
| LD015 | SEQ ID NO: 41 | SEQ ID NO: 42 | SEQ ID NO: 17 |
| LD016 | SEQ ID NO: 43 | SEQ ID NO: 44 | SEQ ID NO: 19 |
| LD018 | SEQ ID NO: 45 | SEQ ID NO: 46 | SEQ ID NO: 21 |
| LD027 | SEQ ID NO: 47 | SEQ ID NO: 48 | SEQ ID NO: 23 |

TABLE 3

LD
Corresponding amino acid sequence of cDNA clone

SEQ ID NO: 2 (frame +1)
SEQ ID NO: 4 (frame −3)
SEQ ID NO: 6 (frame −2)
SEQ ID NO: 8 (frame +1)

TABLE 3-continued

LD
Corresponding amino acid sequence of cDNA clone

SEQ ID NO: 10 (frame +1)
SEQ ID NO: 12 (frame +1)
SEQ ID NO: 14 (frame −1)
SEQ ID NO: 16 (frame +3)
SEQ ID NO: 18 (frame −1)
SEQ ID NO: 20 (frame −2)
SEQ ID NO: 22 (frame +2)
SEQ ID NO: 24 (frame +1)

TABLE 2

PC

| Target ID | Primer Forward 5' → 3' | Primer Reverse 5' → 3' | cDNA Sequence (sense strand) 5' → 3' |
|---|---|---|---|
| PC001 | SEQ ID NO: 261 | SEQ ID NO: 262 | SEQ ID NO: 247 |
| PC003 | SEQ ID NO: 263 | SEQ ID NO: 264 | SEQ ID NO: 249 |
| PC005 | SEQ ID NO: 265 | SEQ ID NO: 266 | SEQ ID NO: 251 |
| PC010 | SEQ ID NO: 267 | SEQ ID NO: 268 | SEQ ID NO: 253 |
| PC014 | SEQ ID NO: 269 | SEQ ID NO: 270 | SEQ ID NO: 255 |
| PC016 | SEQ ID NO: 271 | SEQ ID NO: 272 | SEQ ID NO: 257 |
| PC027 | SEQ ID NO: 273 | SEQ ID NO: 274 | SEQ ID NO: 259 |

TABLE 3

PC
Corresponding amino acid sequence of cDNA clone

SEQ ID NO: 248 (frame +1)
SEQ ID NO: 250 (frame: +2)
SEQ ID NO: 252 (frame +3)
SEQ ID NO: 254 (frame +3)
SEQ ID NO: 256 (frame +3)
SEQ ID NO: 258 (frame +2)
SEQ ID NO: 260 (frame +1)

TABLE 2

EV

| Target ID | Primer Forward 5' → 3' | Primer Reverse 5' → 3' | cDNA Sequence (sense strand) 5' → 3' |
|---|---|---|---|
| EV005 | SEQ ID NO: 523 | SEQ ID NO: 524 | SEQ ID NO: 513 |
| EV009 | SEQ ID NO: 525 | SEQ ID NO: 526 | SEQ ID NO: 515 |
| EV010 | SEQ ID NO: 527 | SEQ ID NO: 528 | SEQ ID NO: 517 |
| EV015 | SEQ ID NO: 529 | SEQ ID NO: 530 | SEQ ID NO: 519 |
| EV016 | SEQ ID NO: 531 | SEQ ID NO: 532 | SEQ ID NO: 521 |

TABLE 3

EV
Corresponding amino acid sequence of cDNA clone

SEQ ID NO: 514 (frame +3)
SEQ ID NO: 516 (frame +1)
SEQ ID NO: 518 (frame +3)
SEQ ID NO: 520 (frame +1)
SEQ ID NO: 522 (frame +2)

TABLE 2

AG

| Target ID | Primer Forward 5' → 3' | Primer Reverse 5' → 3' | cDNA Sequence (sense strand) 5' → 3' |
|---|---|---|---|
| AG001 | SEQ ID NO: 611 | SEQ ID NO: 612 | SEQ ID NO: 601 |
| AG005 | SEQ ID NO: 613 | SEQ ID NO: 614 | SEQ ID NO: 603 |
| AG010 | SEQ ID NO: 615 | SEQ ID NO: 616 | SEQ ID NO: 605 |
| AG014 | SEQ ID NO: 617 | SEQ ID NO: 618 | SEQ ID NO: 607 |
| AG016 | SEQ ID NO: 619 | SEQ ID NO: 620 | SEQ ID NO: 609 |

TABLE 3

AG
Corresponding amino acid sequence of cDNA clone

SEQ ID NO: 602 (frame +1)
SEQ ID NO: 604 (frame +2)
SEQ ID NO: 606 (frame +3)
SEQ ID NO: 608 (frame +3)
SEQ ID NO: 610 (frame +1)

TABLE 2

TC

| Target ID | Primer Forward 5' → 3' | Primer Reverse 5' → 3' | cDNA Sequence (sense strand) 5' → 3' |
|---|---|---|---|
| TC001 | SEQ ID NO: 803 | SEQ ID NO: 804 | SEQ ID NO: 793 |
| TC002 | SEQ ID NO: 805 | SEQ ID NO: 806 | SEQ ID NO: 795 |
| TC010 | SEQ ID NO: 807 | SEQ ID NO: 808 | SEQ ID NO: 797 |
| TC014 | SEQ ID NO: 809 | SEQ ID NO: 810 | SEQ ID NO: 799 |
| TC015 | SEQ ID NO: 811 | SEQ ID NO: 812 | SEQ ID NO: 801 |

TABLE 3

TC
Corresponding amino acid sequence of cDNA clone

SEQ ID NO: 794 (frame +1)
SEQ ID NO: 796 (frame +1)
SEQ ID NO: 798 (frame +3)
SEQ ID NO: 800 (frame +1)
SEQ ID NO: 802 (frame +2)

TABLE 2

MP

| Target ID | Primer Forward 5' → 3' | Primer Reverse 5' → 3' | cDNA Sequence (sense strand) 5' → 3' |
|---|---|---|---|
| MP001 | SEQ ID NO: 898 | SEQ ID NO: 899 | SEQ ID NO: 888 |
| MP002 | SEQ ID NO: 900 | SEQ ID NO: 901 | SEQ ID NO: 890 |
| MP010 | SEQ ID NO: 902 | SEQ ID NO: 903 | SEQ ID NO: 892 |
| MP016 | SEQ ID NO: 904 | SEQ ID NO: 905 | SEQ ID NO: 894 |
| MP027 | SEQ ID NO: 906 | SEQ ID NO: 907 | SEQ ID NO: 896 |

TABLE 3

MP
Corresponding amino acid sequence of cDNA clone

SEQ ID NO: 889 (frame +1)
SEQ ID NO: 891 (frame +2)
SEQ ID NO: 893 (frame +3)
SEQ ID NO: 895 (frame +1)
SEQ ID NO: 897 (frame +3)

TABLE 2

NL

| Target ID | Primer Forward 5'→3' | Primer Reverse 5'→3' | cDNA Sequence (sense strand) 5'→3' |
|---|---|---|---|
| NL001 | SEQ ID NO: 1117 | SEQ ID NO: 1118 | SEQ ID NO: 1071 |
| NL002 | SEQ ID NO: 1119 | SEQ ID NO: 1120 | SEQ ID NO: 1073 |
| NL003 | SEQ ID NO: 1121 | SEQ ID NO: 1122 | SEQ ID NO: 1075 |
| NL004 | SEQ ID NO: 1123 | SEQ ID NO: 1124 | SEQ ID NO: 1077 |
| NL005 | SEQ ID NO: 1125 | SEQ ID NO: 1126 | SEQ ID NO: 1079 |
| NL006 | SEQ ID NO: 1127 | SEQ ID NO: 1128 | SEQ ID NO: 1081 |
| NL007 | SEQ ID NO: 1129 | SEQ ID NO: 1130 | SEQ ID NO: 1083 |
| NL008 | SEQ ID NO: 1131 | SEQ ID NO: 1132 | SEQ ID NO: 1085 |
| NL009 | SEQ ID NO: 1133 | SEQ ID NO: 1134 | SEQ ID NO: 1087 |
| NL010 | SEQ ID NO: 1135 | SEQ ID NO: 1136 | SEQ ID NO: 1089 (amino terminus) SEQ ID NO: 1115 (C terminus) |
| NL011 | SEQ ID NO: 1137 | SEQ ID NO: 1138 | SEQ ID NO: 1091 |
| NL012 | SEQ ID NO: 1139 | SEQ ID NO: 1140 | SEQ ID NO: 1093 |
| NL013 | SEQ ID NO: 1141 | SEQ ID NO: 1142 | SEQ ID NO: 1095 |
| NL014 | SEQ ID NO: 1143 | SEQ ID NO: 1144 | SEQ ID NO: 1097 |
| NL015 | SEQ ID NO: 1145 | SEQ ID NO: 1146 | SEQ ID NO: 1099 |
| NL016 | SEQ ID NO: 1147 | SEQ ID NO: 1148 | SEQ ID NO: 1101 |
| NL018 | SEQ ID NO: 1149 | SEQ ID NO: 1150 | SEQ ID NO: 1103 |
| NL019 | SEQ ID NO: 1151 | SEQ ID NO: 1152 | SEQ ID NO: 1105 |
| NL021 | SEQ ID NO: 1153 | SEQ ID NO: 1154 | SEQ ID NO: 1107 |
| NL022 | SEQ ID NO: 1155 | SEQ ID NO: 1156 | SEQ ID NO: 1109 |
| NL023 | SEQ ID NO: 1157 | SEQ ID NO: 1158 | SEQ ID NO: 1111 |
| NL027 | SEQ ID NO: 1159 | SEQ ID NO: 1160 | SEQ ID NO: 1113 |

TABLE 3

NL
Corresponding amino acid sequence of cDNA clone

SEQ ID NO: 1072 (frame +2)
SEQ ID NO: 1074 (frame +1)
SEQ ID NO: 1076 (frame +2)
SEQ ID NO: 1078 (frame +1)
SEQ ID NO: 1080 (frame +1)
SEQ ID NO: 1082 (frame +3)
SEQ ID NO: 1084 (frame +2)
SEQ ID NO: 1086 (frame +1)
SEQ ID NO: 1088 (frame +1)
SEQ ID NO: 1090 (amino terminus end) (frame +2)
SEQ ID NO: 1116 (carboxy terminus end) (frame +3)
SEQ ID NO: 1092 (frame +2)
SEQ ID NO: 1094 (frame +2)
SEQ ID NO: 1096 (frame +2)
SEQ ID NO: 1098 (frame +2)
SEQ ID NO: 1100 (frame +1)
SEQ ID NO: 1102 (frame +2)
SEQ ID NO: 1104 (frame +2)
SEQ ID NO: 1106 (frame +2)
SEQ ID NO: 1108 (frame +2)
SEQ ID NO: 1110 (frame +2)
SEQ ID NO: 1112 (frame +2)
SEQ ID NO: 1114 (frame +2)

TABLE 2

CS

| Target ID | Primer Forward 5'→3' | Primer Reverse 5'→3' | cDNA Sequence (sense strand) 5'→3' |
|---|---|---|---|
| CS001 | SEQ ID NO: 1706 | SEQ ID NO: 1707 | SEQ ID NO: 1682 |
| CS002 | SEQ ID NO: 1708 | SEQ ID NO: 1709 | SEQ ID NO: 1684 |
| CS003 | SEQ ID NO: 1710 | SEQ ID NO: 1711 | SEQ ID NO: 1686 |
| CS006 | SEQ ID NO: 1712 | SEQ ID NO: 1713 | SEQ ID NO: 1688 |
| CS007 | SEQ ID NO: 1714 | SEQ ID NO: 1715 | SEQ ID NO: 1690 |
| CS009 | SEQ ID NO: 1716 | SEQ ID NO: 1717 | SEQ ID NO: 1692 |
| CS011 | SEQ ID NO: 1718 | SEQ ID NO: 1719 | SEQ ID NO: 1694 |
| CS013 | SEQ ID NO: 1720 | SEQ ID NO: 1721 | SEQ ID NO: 1696 |
| CS014 | SEQ ID NO: 1722 | SEQ ID NO: 1723 | SEQ ID NO: 1698 |
| CS015 | SEQ ID NO: 1724 | SEQ ID NO: 1725 | SEQ ID NO: 1700 |
| CS016 | SEQ ID NO: 1726 | SEQ ID NO: 1727 | SEQ ID NO: 1702 |
| CS018 | SEQ ID NO: 1728 | SEQ ID NO: 1729 | SEQ ID NO: 1704 |

TABLE 3

CS
Corresponding amino acid sequence of cDNA clone

SEQ ID NO: 1683 (frame +1)
SEQ ID NO: 1685 (frame +1)
SEQ ID NO: 1687 (frame +1)
SEQ ID NO: 1689 (frame +1)
SEQ ID NO: 1691 (frame +3)
SEQ ID NO: 1693 (frame +1)
SEQ ID NO: 1695 (frame +1)
SEQ ID NO: 1697 (frame +2)
SEQ ID NO: 1699 (frame +2)
SEQ ID NO: 1701 (frame +1)
SEQ ID NO: 1703 (frame −3)
SEQ ID NO: 1705 (frame +2)

TABLE 2

PX

| Target ID | Primer Forward 5'→3' | Primer Reverse 5'→3' | cDNA Sequence (sense strand) 5'→3' |
|---|---|---|---|
| PX001 | SEQ ID NO: 2110 | SEQ ID NO: 2111 | SEQ ID NO: 2100 |
| PX009 | SEQ ID NO: 2112 | SEQ ID NO: 2113 | SEQ ID NO: 2102 |
| PX010 | SEQ ID NO: 2114 | SEQ ID NO: 2115 | SEQ ID NO: 2104 |
| PX015 | SEQ ID NO: 2116 | SEQ ID NO: 2117 | SEQ ID NO: 2106 |
| PX016 | SEQ ID NO: 2118 | SEQ ID NO: 2119 | SEQ ID NO: 2108 |

TABLE 3

PX
Corresponding amino acid sequence of cDNA clone

SEQ ID NO: 2101 (frame +1)
SEQ ID NO: 2103 (frame +3)
SEQ ID NO: 2105 (frame +3)
SEQ ID NO: 2107 (frame +3)
SEQ ID NO: 2109 (frame +2)

TABLE 2

AD

| Target ID | Primer Forward 5'→3' | Primer Reverse 5'→3' | cDNA Sequence (sense strand) 5'→3' |
|---|---|---|---|
| AD001 | SEQ ID NO: 2374 | SEQ ID NO: 2375 | SEQ ID NO: 2364 |
| AD002 | SEQ ID NO: 2376 | SEQ ID NO: 2377 | SEQ ID NO: 2366 |

TABLE 2-continued

AD

| Target ID | Primer Forward 5' → 3' | Primer Reverse 5' → 3' | cDNA Sequence (sense strand) 5' → 3' |
|---|---|---|---|
| AD009 | SEQ ID NO: 2378 | SEQ ID NO: 2379 | SEQ ID NO: 2368 |
| AD015 | SEQ ID NO: 2380 | SEQ ID NO: 2381 | SEQ ID NO: 2370 |
| AD016 | SEQ ID NO: 2382 | SEQ ID NO: 2383 | SEQ ID NO: 2372 |

TABLE 3

AD
Corresponding amino acid sequence of cDNA clone

SEQ ID NO: 2365 (frame +1)
SEQ ID NO: 2367 (frame +2)
SEQ ID NO: 2369 (frame +3)
SEQ ID NO: 2371 (frame +2)
SEQ ID NO: 2373 (frame +2)

TABLES 4

LD/PC/EV/AG/TC/MP/NL/PX

| Target ID | SEQ ID NO | Example Gi-number and species |
|---|---|---|
| LD010 | 75 | 29558345 (*Bombyx mori*) |
| LD010 | 76 | 49559866 (*Boophilus microplus*) |
| LD010 | 77 | 60293559 (*Homalodisca coagulata*) |
| LD010 | 78 | 92971011 (*Drosophila mojavensis*) |
| LD010 | 79 | 92952825 (*Drosophila ananassae*) |
| LD010 | 80 | 92921253 (*Drosophila virilis*) |
| LD010 | 81 | 92921253 (*Drosophila virilis*) |
| PC010 | 368 | 92952825 (*Drosophila ananassae*) |
| PC010 | 369 | 58395529 (*Anopheles gambiae* str. PEST) |
| PC010 | 370 | 56152422 (*Rhynchosciara americana*) |
| PC010 | 371 | 92939820 (*Drosophila virilis*) |
| PC010 | 372 | 83937570 (*Lutzomyia longipalpis*) |
| PC010 | 373 | 3337934 (*Drosophila melanogaster*) |
| EV010 | 540 | 83937567 (*Lutzomyia longipalpis*) |
| EV010 | 541 | 29558345 (*Bombyx mori*) |
| EV010 | 542 | 92476940 (*Drosophila erecta*); 92977931 (*Drosophila grimshawi*); 2871327 (*Drosophila melanogaster*) |
| AG010 | 692 | 78539702 (*Glossina morsitans*) |
| AG010 | 693 | 110759793 (*Apis mellifera*) |
| AG010 | 694 | 55902158 (*Locusta migratoria*) |
| AG010 | 695 | 92925934 (*Drosophila virilis*) |
| TC010 | 833 | 90973566 (*Aedes aegypti*) |
| TC010 | 834 | 92944620 (*Drosophila ananassae*) |
| TC010 | 835 | 33427937 (*Glossina morsitans*) |
| TC010 | 836 | 56151768 (*Rhynchosciara americana*) |
| TC010 | 837 | 18911059 (*Anopheles gambiae*) |
| TC010 | 838 | 67893321 (*Drosophila pseudoobscura*) |
| TC010 | 839 | 67893324 (*Drosophila pseudoobscura*) |
| TC010 | 840 | 67893321 (*Drosophila pseudoobscura*) |
| TC010 | 841 | 92952825 (*Drosophila ananassae*) |
| MP010 | 964 | 110759793 (*Apis mellifera*) |
| MP010 | 965 | 47520567 (*Acyrthosiphon pisum*) |
| MP010 | 966 | 47520567 (*Acyrthosiphon pisum*) |
| MP010 | 967 | 47520567 (*Acyrthosiphon pisum*) |
| MP010 | 968 | 47520567 (*Acyrthosiphon pisum*) |
| MP010 | 969 | 47520567 (*Acyrthosiphon pisum*) |
| MP010 | 970 | 47520567 (*Acyrthosiphon pisum*) |
| MP010 | 971 | 55814942 (*Acyrthosiphon pisum*) |
| MP010 | 972 | 55814942 (*Acyrthosiphon pisum*) |
| MP010 | 973 | 55814942 (*Acyrthosiphon pisum*) |
| MP010 | 974 | 28571527 (*Drosophila melanogaster*) |
| MP010 | 975 | 47520567 (*Acyrthosiphon pisum*) |
| MP010 | 976 | 40924332 (*Bombyx mori*) |
| MP010 | 977 | 47520567 (*Acyrthosiphon pisum*) |
| MP010 | 978 | 47520567 (*Acyrthosiphon pisum*) |

TABLES 4-continued

LD/PC/EV/AG/TC/MP/NL/PX

| Target ID | SEQ ID NO | Example Gi-number and species |
|---|---|---|
| NL010_1 | 1290 | 2761430 (*Drosophila melanogaster*) |
| NL010_1 | 1291 | 49559867 (*Boophilus microplus*) |
| NL010_1 | 1292 | 49559867 (*Boophilus microplus*) |
| NL010_1 | 1293 | 92043082 (*Drosophila willistoni*) |
| NL010_1 | 1294 | 92481328 (*Drosophila erecta*) 28571527 (*Drosophila melanogaster*) |
| NL010_2 | 1295 | 33427937 (*Glossina morsitans*) |
| NL010_2 | 1296 | 47520567 (*Acyrthosiphon pisum*) |
| NL010_2 | 1297 | 47520567 (*Acyrthosiphon pisum*) |
| NL010_2 | 1298 | 55891325 (*Locusta migratoria*) |
| NL010_2 | 1299 | 56151768 (*Rhynchosciara americana*), 75736992 (*Tribolium castaneum*) |
| NL010_2 | 1300 | 6932015 (*Anopheles gambiae*), 29558345 (*Bombyx mori*) |
| NL010_2 | 1301 | 91086194 (*Tribolium castaneum*) |
| PX010 | 2178 | 71553175 (*Oncometopia nigricans*) |
| PX010 | 2179 | 90139187 (*Spodoptera frugiperda*) |
| PX010 | 2180 | 67893194 (*Drosophila pseudoobscura*) |
| PX010 | 2181 | 29558345 (*Bombyx mori*) |
| PX010 | 2182 | 58395529 (*Anopheles gambiae* str. PEST) |
| PX010 | 2183 | 18872210 (*Anopheles gambiae*) |
| PX010 | 2184 | 29558345 (*Bombyx mori*) |
| PX010 | 2185 | 29558345 (*Bombyx mori*) |
| PX010 | 2186 | 18872210 (*Anopheles gambiae*) |
| PX010 | 2187 | 77886140 (*Aedes aegypti*); 18872210 (*Anopheles gambiae*); 49376735 (*Drosophila melanogaster*); 67893324 (*Drosophila pseudoobscura*) |
| PX010 | 2188 | 91757875 (*Bombyx mori*) |
| PX010 | 2189 | 28571527 (*Drosophila melanogaster*) |
| PX010 | 2190 | 92932090 (*Drosophila virilis*) |
| PX010 | 2191 | 67893324 (*Drosophila pseudoobscura*) |
| PX010 | 2192 | 92952825 (*Drosophila ananassae*) |
| PX010 | 2193 | 28571527 (*Drosophila melanogaster*) |
| PX010 | 2194 | 82842646 (*Boophilus microplus*) |

TABLES 6

LD/PC/EV/AG/TC/MP/NL/PX

| Target ID | SEQ ID NO | Example Gi-number and species |
|---|---|---|
| PC010 | 457 | 50288722 (*Candida glabrata* CBS 138) |
| PC010 | 458 | 70990481 (*Aspergillus fumigatus*) |
| PC010 | 459 | 90631635 (*Thermomyces lanuginosus*) |
| EV010 | 565 | 50405834 (*Debaryomyces hansenii*) |
| MP010 | 1027 | 48564349 (*Coccidioides posadasii*) |
| NL010_2 | 1506 | 68478799 (*Candida albicans*) |
| NL010_2 | 1507 | 21649260 (*Conidiobolus coronatus*) |
| NL010_2 | 1508 | 47031965 (*Mycosphaerella graminicola*) |
| PX010 | 2311 | 90542152 (*Gloeophyllum trabeum*) |
| PX010 | 2312 | 84578035 (*Aspergillus oryzae*) |
| PX010 | 2313 | 39978050 (*Magnaporthe grisea*) |
| PX010 | 2314 | 90618424 (*Corynascus heterothallicus*) |

TABLE 8

LD

| Target ID | Primers Forward 5' → 3' | Primers Reverse 5' → 3' | dsRNA DNA Sequence (sense strand) 5' → 3' |
|---|---|---|---|
| LD001 | SEQ ID NO: 164 SEQ ID NO: 166 | SEQ ID NO: 165 SEQ ID NO: 167 | SEQ ID NO: 163 |
| LD002 | SEQ ID NO: 169 SEQ ID NO: 171 | SEQ ID NO: 170 SEQ ID NO: 172 | SEQ ID NO: 168 |
| LD003 | SEQ ID NO: 174 SEQ ID NO: 176 | SEQ ID NO: 175 SEQ ID NO: 177 | SEQ ID NO: 173 |

TABLE 8-continued

LD

| Target ID | Primers Forward 5'→3' | Primers Reverse 5'→3' | dsRNA DNA Sequence (sense strand) 5'→3' |
|---|---|---|---|
| LD006 | SEQ ID NO: 179<br>SEQ ID NO: 181 | SEQ ID NO: 180<br>SEQ ID NO: 182 | SEQ ID NO: 178 |
| LD007 | SEQ ID NO: 184<br>SEQ ID NO: 186 | SEQ ID NO: 185<br>SEQ ID NO: 187 | SEQ ID NO: 183 |
| LD010 | SEQ ID NO: 189<br>SEQ ID NO: 191 | SEQ ID NO: 190<br>SEQ ID NO: 192 | SEQ ID NO: 188<br>SEQ ID NO: 2495 |
| LD011 | SEQ ID NO: 194<br>SEQ ID NO: 196 | SEQ ID NO: 195<br>SEQ ID NO: 197 | SEQ ID NO: 193 |
| LD014 | SEQ ID NO: 199<br>SEQ ID NO: 201 | SEQ ID NO: 200<br>SEQ ID NO: 202 | SEQ ID NO: 198 |
| LD014_F1 | SEQ ID NO: 204<br>SEQ ID NO: 206 | SEQ ID NO: 205<br>SEQ ID NO: 207 | SEQ ID NO: 203 |
| LD014_F2 | SEQ ID NO: 209<br>SEQ ID NO: 211 | SEQ ID NO: 210<br>SEQ ID NO: 212 | SEQ ID NO: 208 |
| LD014_C1 | | | SEQ ID NO: 213 |
| LD014_C2 | | | SEQ ID NO: 214 |
| LD015 | SEQ ID NO: 216<br>SEQ ID NO: 218 | SEQ ID NO: 217<br>SEQ ID NO: 219 | SEQ ID NO: 215 |
| LD016 | SEQ ID NO: 221<br>SEQ ID NO: 223 | SEQ ID NO: 222<br>SEQ ID NO: 224 | SEQ ID NO: 220 |
| LD018 | SEQ ID NO: 226<br>SEQ ID NO: 228 | SEQ ID NO: 227<br>SEQ ID NO: 229 | SEQ ID NO: 225 |
| LD027 | SEQ ID NO: 231<br>SEQ ID NO: 233 | SEQ ID NO: 232<br>SEQ ID NO: 234 | SEQ ID NO: 230 |
| gfp | SEQ ID NO: 236<br>SEQ ID NO: 238 | SEQ ID NO: 237<br>SEQ ID NO: 239 | SEQ ID NO: 235 |

TABLE 8

PC

| Target ID | Primers Forward 5'→3' | Primers Reverse 5'→3' | dsRNA DNA Sequence (sense strand) 5'→3' |
|---|---|---|---|
| PC001 | SEQ ID NO: 474<br>SEQ ID NO: 476 | SEQ ID NO: 475<br>SEQ ID NO: 477 | SEQ ID NO: 473 |
| PC003 | SEQ ID NO: 479<br>SEQ ID NO: 481 | SEQ ID NO: 480<br>SEQ ID NO: 482 | SEQ ID NO: 478 |
| PC005 | SEQ ID NO: 484<br>SEQ ID NO: 486 | SEQ ID NO: 485<br>SEQ ID NO: 487 | SEQ ID NO: 483 |
| PC010 | SEQ ID NO: 489<br>SEQ ID NO: 491 | SEQ ID NO: 490<br>SEQ ID NO: 492 | SEQ ID NO: 488 |
| PC014 | SEQ ID NO: 494<br>SEQ ID NO: 496 | SEQ ID NO: 495<br>SEQ ID NO: 497 | SEQ ID NO: 493 |
| PC016 | SEQ ID NO: 499<br>SEQ ID NO: 501 | SEQ ID NO: 500<br>SEQ ID NO: 502 | SEQ ID NO: 498 |
| PC027 | SEQ ID NO: 504<br>SEQ ID NO: 506 | SEQ ID NO: 505<br>SEQ ID NO: 507 | SEQ ID NO: 503 |

TABLE 8

EV

| Target ID | Primers Forward 5'→3' | Primers Reverse 5'→3' | dsRNA DNA Sequence (sense strand) 5'→3' |
|---|---|---|---|
| EV005 | SEQ ID NO: 577<br>SEQ ID NO: 579 | SEQ ID NO: 578<br>SEQ ID NO: 580 | SEQ ID NO: 576 |
| EV009 | SEQ ID NO: 582<br>SEQ ID NO: 584 | SEQ ID NO: 583<br>SEQ ID NO: 585 | SEQ ID NO: 581 |
| EV010 | SEQ ID NO: 587<br>SEQ ID NO: 589 | SEQ ID NO: 588<br>SEQ ID NO: 590 | SEQ ID NO: 586 |
| EV015 | SEQ ID NO: 592<br>SEQ ID NO: 594 | SEQ ID NO: 593<br>SEQ ID NO: 595 | SEQ ID NO: 591 |
| EV016 | SEQ ID NO: 597<br>SEQ ID NO: 599 | SEQ ID NO: 598<br>SEQ ID NO: 600 | SEQ ID NO: 596 |

TABLE 8

AG

| Target ID | Primers Forward 5'→3' | Primers Reverse 5'→3' | dsRNA DNA Sequence (sense strand) 5'→3' |
|---|---|---|---|
| AG001 | SEQ ID NO: 769<br>SEQ ID NO: 771 | SEQ ID NO: 770<br>SEQ ID NO: 772 | SEQ ID NO: 768 |
| AG005 | SEQ ID NO: 774<br>SEQ ID NO: 776 | SEQ ID NO: 775<br>SEQ ID NO: 777 | SEQ ID NO: 773 |
| AG010 | SEQ ID NO: 779<br>SEQ ID NO: 781 | SEQ ID NO: 780<br>SEQ ID NO: 782 | SEQ ID NO: 778 |
| AG014 | SEQ ID NO: 784<br>SEQ ID NO: 786 | SEQ ID NO: 785<br>SEQ ID NO: 787 | SEQ ID NO: 783 |
| AG016 | SEQ ID NO: 789<br>SEQ ID NO: 791 | SEQ ID NO: 790<br>SEQ ID NO: 792 | SEQ ID NO: 788 |

TABLE 8

TC

| Target ID | Primers Forward 5'→3' | Primers Reverse 5'→3' | dsRNA DNA Sequence (sense strand) 5'→3' |
|---|---|---|---|
| TC001 | SEQ ID NO: 864<br>SEQ ID NO: 866 | SEQ ID NO: 865<br>SEQ ID NO: 867 | SEQ ID NO: 863 |
| TC002 | SEQ ID NO: 869<br>SEQ ID NO: 871 | SEQ ID NO: 870<br>SEQ ID NO: 872 | SEQ ID NO: 868 |
| TC010 | SEQ ID NO: 874<br>SEQ ID NO: 876 | SEQ ID NO: 875<br>SEQ ID NO: 877 | SEQ ID NO: 873 |
| TC014 | SEQ ID NO: 879<br>SEQ ID NO: 881 | SEQ ID NO: 880<br>SEQ ID NO: 882 | SEQ ID NO: 878 |
| TC015 | SEQ ID NO: 884<br>SEQ ID NO: 886 | SEQ ID NO: 885<br>SEQ ID NO: 887 | SEQ ID NO: 883 |

TABLE 8

MP

| Target ID | Primers Forward 5'→3' | Primers Reverse 5'→3' | dsRNA DNA Sequence (sense strand) 5'→3' |
|---|---|---|---|
| MP001 | SEQ ID NO: 1042<br>SEQ ID NO: 1044 | SEQ ID NO: 1043<br>SEQ ID NO: 1045 | SEQ ID NO: 1041 |
| MP002 | SEQ ID NO: 1047<br>SEQ ID NO: 1049 | SEQ ID NO: 1048<br>SEQ ID NO: 1050 | SEQ ID NO: 1046 |
| MP010 | SEQ ID NO: 1052<br>SEQ ID NO: 1054 | SEQ ID NO: 1053<br>SEQ ID NO: 1055 | SEQ ID NO: 1051 |
| MP016 | SEQ ID NO: 1057<br>SEQ ID NO: 1059 | SEQ ID NO: 1058<br>SEQ ID NO: 1060 | SEQ ID NO: 1056 |
| MP027 | SEQ ID NO: 1062<br>SEQ ID NO: 1064 | SEQ ID NO: 1063<br>SEQ ID NO: 1065 | SEQ ID NO: 1061 |

TABLE 8

NL

| Target ID | Primers Forward 5'→3' | Primers Reverse 5'→3' | dsRNA DNA Sequence (sense strand) 5'→3' |
|---|---|---|---|
| NL001 | SEQ ID NO: 1573<br>SEQ ID NO: 1575 | SEQ ID NO: 1574<br>SEQ ID NO: 1576 | SEQ ID NO: 1572 |
| NL002 | SEQ ID NO: 1578<br>SEQ ID NO: 1580 | SEQ ID NO: 1579<br>SEQ ID NO: 1581 | SEQ ID NO: 1577 |
| NL003 | SEQ ID NO: 1583<br>SEQ ID NO: 1585 | SEQ ID NO: 1584<br>SEQ ID NO: 1586 | SEQ ID NO: 1582 |
| NL004 | SEQ ID NO: 1588<br>SEQ ID NO: 1590 | SEQ ID NO: 1589<br>SEQ ID NO: 1591 | SEQ ID NO: 1587 |
| NL005 | SEQ ID NO: 1593<br>SEQ ID NO: 1595 | SEQ ID NO: 1594<br>SEQ ID NO: 1596 | SEQ ID NO: 1592 |

TABLE 8-continued

NL

| Target ID | Primers Forward 5' → 3' | Primers Reverse 5' → 3' | dsRNA DNA Sequence 5' → 3' |
|---|---|---|---|
| NL006 | SEQ ID NO: 1598<br>SEQ ID NO: 1600 | SEQ ID NO: 1599<br>SEQ ID NO: 1601 | SEQ ID NO: 1597 |
| NL007 | SEQ ID NO: 1603<br>SEQ ID NO: 1605 | SEQ ID NO: 1604<br>SEQ ID NO: 1606 | SEQ ID NO: 1602 |
| NL008 | SEQ ID NO: 1608<br>SEQ ID NO: 1610 | SEQ ID NO: 1609<br>SEQ ID NO: 1611 | SEQ ID NO: 1607 |
| NL009 | SEQ ID NO: 1613<br>SEQ ID NO: 1615 | SEQ ID NO: 1614<br>SEQ ID NO: 1616 | SEQ ID NO: 1612 |
| NL010 | SEQ ID NO: 1618<br>SEQ ID NO: 1620 | SEQ ID NO: 1619<br>SEQ ID NO: 1621 | SEQ ID NO: 1617 |
| NL011 | SEQ ID NO: 1623<br>SEQ ID NO: 1625 | SEQ ID NO: 1624<br>SEQ ID NO: 1626 | SEQ ID NO: 1622 |
| NL012 | SEQ ID NO: 1628<br>SEQ ID NO: 1630 | SEQ ID NO: 1629<br>SEQ ID NO: 1631 | SEQ ID NO: 1627 |
| NL013 | SEQ ID NO: 1633<br>SEQ ID NO: 1635 | SEQ ID NO: 1634<br>SEQ ID NO: 1636 | SEQ ID NO: 1632 |
| NL014 | SEQ ID NO: 1638<br>SEQ ID NO: 1640 | SEQ ID NO: 1639<br>SEQ ID NO: 1641 | SEQ ID NO: 1637 |
| NL015 | SEQ ID NO: 1643<br>SEQ ID NO: 1645 | SEQ ID NO: 1644<br>SEQ ID NO: 1646 | SEQ ID NO: 1642 |
| NL016 | SEQ ID NO: 1648<br>SEQ ID NO: 1650 | SEQ ID NO: 1649<br>SEQ ID NO: 1651 | SEQ ID NO: 1647 |
| NL018 | SEQ ID NO: 1653<br>SEQ ID NO: 1655 | SEQ ID NO: 1654<br>SEQ ID NO: 1656 | SEQ ID NO: 1652 |
| NL019 | SEQ ID NO: 1658<br>SEQ ID NO: 1660 | SEQ ID NO: 1659<br>SEQ ID NO: 1661 | SEQ ID NO: 1657 |
| NL021 | SEQ ID NO: 1663<br>SEQ ID NO: 1665 | SEQ ID NO: 1664<br>SEQ ID NO: 1666 | SEQ ID NO: 1662 |
| NL022 | SEQ ID NO: 1668<br>SEQ ID NO: 1670 | SEQ ID NO: 1669<br>SEQ ID NO: 1671 | SEQ ID NO: 1667 |
| NL023 | SEQ ID NO: 1673<br>SEQ ID NO: 1675 | SEQ ID NO: 1674<br>SEQ ID NO: 1676 | SEQ ID NO: 1672 |
| NL027 | SEQ ID NO: 1678<br>SEQ ID NO: 1680 | SEQ ID NO: 1679<br>SEQ ID NO: 1681 | SEQ ID NO: 1677 |

TABLE 8

CS

| Target ID | Primers Forward 5' → 3' | Primers Reverse 5' → 3' | dsRNA DNA Sequence (sense strand) 5' → 3' |
|---|---|---|---|
| CS001 | SEQ ID NO: 2041<br>SEQ ID NO: 2043 | SEQ ID NO: 2042<br>SEQ ID NO: 2044 | SEQ ID NO: 2040 |
| CS002 | SEQ ID NO: 2046<br>SEQ ID NO: 2048 | SEQ ID NO: 2047<br>SEQ ID NO: 2049 | SEQ ID NO: 2045 |
| CS003 | SEQ ID NO: 2051<br>SEQ ID NO: 2053 | SEQ ID NO: 2052<br>SEQ ID NO: 2054 | SEQ ID NO: 2050 |
| CS006 | SEQ ID NO: 2056<br>SEQ ID NO: 2058 | SEQ ID NO: 2057<br>SEQ ID NO: 2059 | SEQ ID NO: 2055 |
| CS007 | SEQ ID NO: 2061<br>SEQ ID NO: 2063 | SEQ ID NO: 2062<br>SEQ ID NO: 2064 | SEQ ID NO: 2060 |
| CS009 | SEQ ID NO: 2066<br>SEQ ID NO: 2068 | SEQ ID NO: 2067<br>SEQ ID NO: 2069 | SEQ ID NO: 2065 |
| CS011 | SEQ ID NO 2071<br>SEQ ID NO: 2073 | SEQ ID NO: 2072<br>SEQ ID NO: 2074 | SEQ ID NO: 2070 |
| CS013 | SEQ ID NO: 2076<br>SEQ ID NO: 2078 | SEQ ID NO: 2077<br>SEQ ID NO: 2079 | SEQ ID NO: 2075 |
| CS014 | SEQ ID NO: 2081<br>SEQ ID NO: 2083 | SEQ ID NO: 2082<br>SEQ ID NO: 2084 | SEQ ID NO: 2080 |
| CS015 | SEQ ID NO: 2086<br>SEQ ID NO: 2088 | SEQ ID NO: 2087<br>SEQ ID NO: 2089 | SEQ ID NO: 2085 |
| CS016 | SEQ ID NO: 2091<br>SEQ ID NO: 2093 | SEQ ID NO: 2092<br>SEQ ID NO: 2094 | SEQ ID NO: 2090 |
| CS018 | SEQ ID NO: 2096<br>SEQ ID NO: 2098 | SEQ ID NO: 2097<br>SEQ ID NO: 2099 | SEQ ID NO: 2095 |

TABLE 8

PX

| Target ID | Primers Forward 5' → 3' | Primers Reverse 5' → 3' | dsRNA DNA Sequence (sense strand) 5' → 3' |
|---|---|---|---|
| PX001 | SEQ ID NO: 2340<br>SEQ ID NO: 2342 | SEQ ID NO: 2341<br>SEQ ID NO: 2343 | SEQ ID NO: 2339 |
| PX009 | SEQ ID NO: 2345<br>SEQ ID NO: 2347 | SEQ ID NO: 2346<br>SEQ ID NO: 2348 | SEQ ID NO: 2344 |
| PX010 | SEQ ID NO: 2350<br>SEQ ID NO: 2352 | SEQ ID NO: 2351<br>SEQ ID NO: 2353 | SEQ ID NO: 2349 |
| PX015 | SEQ ID NO: 2355<br>SEQ ID NO: 2357 | SEQ ID NO: 2356<br>SEQ ID NO: 2358 | SEQ ID NO: 2354 |
| PX016 | SEQ ID NO: 2360<br>SEQ ID NO: 2362 | SEQ ID NO: 2361<br>SEQ ID NO: 2363 | SEQ ID NO: 2359 |

TABLE 8

AD

| Target ID | Primers Forward 5' → 3' | Primers Reverse 5' → 3' | dsRNA DNA Sequence (sense strand) 5' → 3' |
|---|---|---|---|
| AD001 | SEQ ID NO: 2462<br>SEQ ID NO: 2464 | SEQ ID NO: 2463<br>SEQ ID NO: 2465 | SEQ ID NO: 2461 |
| AD002 | SEQ ID NO: 2467<br>SEQ ID NO: 2469 | SEQ ID NO: 2468<br>SEQ ID NO: 2470 | SEQ ID NO: 2466 |
| AD009 | SEQ ID NO: 2472<br>SEQ ID NO: 2474 | SEQ ID NO: 2473<br>SEQ ID NO: 2475 | SEQ ID NO: 2471 |
| AD015 | SEQ ID NO: 2477<br>SEQ ID NO: 2479 | SEQ ID NO: 2478<br>SEQ ID NO: 2480 | SEQ ID NO: 2476 |
| AD016 | SEQ ID NO: 2482<br>SEQ ID NO: 2484 | SEQ ID NO: 2483<br>SEQ ID NO: 2485 | SEQ ID NO: 2481 |

TABLE 10

LD

| bio-assay | bacterial host strain | treatment | no. of survivors | total weight | average weight/larvae |
|---|---|---|---|---|---|
| I | | diet only | 8* | 1.0245 | 0.1281 |
| | AB309-105 | pGN29 | 8* | 1.0124 | 0.1266 |
| | | pGBNJ003 clone 1 | 4 | 0.0273 | 0.0068 |
| | | pGBNJ003 clone 2 | 1 | 0.0091 | 0.0091 |
| | | pGBNJ003 clone 3 | 25 | 0.7113 | 0.0285 |
| | | pGBNJ003 clone 4 | 12 | 0.1379 | 0.0115 |
| | | pGBNJ003 clone 5 | 12 | 0.1808 | 0.0151 |
| II | | diet only | 8* | 1.0435 | 0.1304 |
| | BL21 (DE3) | pGN29 | 8* | 1.1258 | 0.1407 |
| | | pGBNJ003 clone 1 | 33 | 0.5879 | 0.0178 |
| | | pGBNJ003 clone 2 | 42 | 0.8034 | 0.0191 |
| | | pGBNJ003 clone 3 | 33 | 0.3441 | 0.0104 |
| | | pGBNJ003 clone 4 | 21 | 0.1738 | 0.0083 |
| | | pGBNJ003 clone 5 | 33 | 0.3628 | 0.0120 |

TABLE 10a-NL

| RNAi | Mean % survival (days post start) | | | | | | | | | Survival analysis[1] |
|---|---|---|---|---|---|---|---|---|---|---|
| | 0 | 1 | 2 | 3 | 4 | 5 | 6 | 7 | 8 | |
| gfp | 100 | 98 | 90 | 82 | 68 | 60 | 44 | 32 | 20 | − |
| diet only | 100 | 98 | 96 | 86 | 74 | 68 | 58 | 54 | 38 | − |
| N L002 | 100 | 98 | 90 | 76 | 68 | 34 | 6 | 0 | 0 | + |
| N L003 | 100 | 98 | 74 | 48 | 36 | 22 | 12 | 2 | 0 | + |
| N L005 | 100 | 100 | 74 | 56 | 40 | 20 | 16 | 6 | 4 | + |
| N L010 | 100 | 96 | 74 | 56 | 48 | 30 | 18 | 12 | 8 | + |

[1] = Data were analysed using Kaplan-Meier survival curve analysis

| | Chi squared | P value | Sig. Dif.[2] |
|---|---|---|---|
| diet versus: | | | |
| NL002 | 29.06 | <0.0001 | Yes |
| NL003 | 39.59 | <0.0001 | Yes |
| NL005 | 29.55 | <0.0001 | Yes |
| NL010 | 21.04 | <0.0001 | Yes |
| gfp dsRNA versus: | | | |
| NL002 | 15.09 | 0.0001 | Yes |
| NL003 | 22.87 | <0.0001 | Yes |
| NL005 | 15.12 | <0.0001 | Yes |
| NL010 | 8.838 | 0.0029 | Yes |
| diet versus gfp dsRNA | 4.030 | 0.0447(~0.05) | No |

[2] alpha <0.05

TABLE 10b-NL

| RNAi | Mean % survival (days post start) | | | | | | | | | Survival analysis[1] |
|---|---|---|---|---|---|---|---|---|---|---|
| | 0 | 1 | 2 | 3 | 4 | 5 | 6 | 7 | 8 | |
| gfp | 100 | 96 | 84 | 82 | 76 | 70 | 54 | 50 | 44 | − |
| diet only | 100 | 96 | 88 | 82 | 76 | 70 | 54 | 50 | 44 | − |
| NL009 | 100 | 94 | 75 | 63 | 42 | 30 | 24 | 22 | 14 | + |
| NL016 | 100 | 94 | 84 | 78 | 54 | 44 | 36 | 18 | 14 | + |

[1] = Data were analysed using Kaplan-Meier survival curve analysis

| | Chi squared | P value | Sig. Dif.[2] |
|---|---|---|---|
| diet versus: | | | |
| NL009 | 11.98 | 0.0005 | Yes |
| NL016 | 8.98 | 0.0027 | Yes |
| gfp dsRNA versus: | | | |
| NL009 | 13.69 | 0.0002 | Yes |
| NL016 | 11.37 | 0.0007 | Yes |
| diet versus gfp dsRNA | 0.03317 | 0.8555 | No |

[2] alpha <0.05

TABLE 10c-NL

| RNAi | Mean % survival (days post start) | | | | | | | | | Survival analysis[1] |
|---|---|---|---|---|---|---|---|---|---|---|
| | 0 | 1 | 2 | 3 | 4 | 5 | 6 | 7 | 8 | |
| gfp | 100 | 92 | 84 | 78 | 72 | 62 | 58 | 56 | 48 | − |
| diet only | 100 | 84 | 72 | 68 | 64 | 58 | 52 | 42 | 42 | − |
| NL014 | 100 | 86 | 68 | 60 | 46 | 32 | 24 | 18 | 14 | + |
| NL018 | 100 | 82 | 70 | 54 | 40 | 30 | 18 | 14 | 12 | + |

[1] = Data were analysed using Kaplan-Meier survival curve analysis

| | Chi squared | P value | Sig. Dif.[2] |
|---|---|---|---|
| diet versus: | | | |
| NL014 | 8.088 | 0.0045 | Yes |
| NL018 | 10.47 | 0.0012 | Yes |

TABLE 10c-NL-continued

| gfp dsRNA versus: | | | |
|---|---|---|---|
| NL014 | 14.55 | 0.0001 | Yes |
| NL018 | 17.64 | <0.0001 | Yes |
| diet versus gfp dsRNA | 0.6548 | 0.4184 | No |

[2] alpha <0.05

TABLE 10d-NL

| RNAi | Mean % survival (days post start) | | | | | | | | | | Survival analysis[1] |
|---|---|---|---|---|---|---|---|---|---|---|---|
| | 0 | 1 | 2 | 3 | 4 | 5 | 6 | 7 | 8 | 9 | |
| gfp | 100 | 96 | 84 | 84 | 72 | 68 | 68 | 66 | 66 | 62 | − |
| diet only | 100 | 96 | 86 | 82 | 74 | 72 | 70 | 70 | 66 | 58 | − |
| NL013 | 100 | 94 | 82 | 68 | 50 | 40 | 30 | 28 | 20 | 20 | + |
| NL015 | 100 | 100 | 72 | 30 | 18 | 12 | 8 | 6 | 6 | 6 | + |
| NL021 | 100 | 100 | 84 | 58 | 50 | 44 | 40 | 34 | 34 | 22 | + |

[1] = Data were analysed using Kaplan-Meier survival curve analysis

| | Chi squared | P value | Sig. Dif.[2] |
|---|---|---|---|
| diet versus: | | | |
| NL013 | 15.73 | <0.0001 | Yes |
| NL015 | 39.44 | <0.0001 | Yes |
| NL021 | 12.75 | 0.0004 | Yes |
| gfp dsRNA versus: | | | |
| NL013 | 16.42 | <0.0001 | Yes |
| NL015 | 39.15 | <0.0001 | Yes |
| NL021 | 14.1 | 0.0002 | Yes |
| diet versus gfp dsRNA | 0.1031 | 0.7481 | No |

[2] alpha <0.05

TABLE 11-NL

| NL002 RNAi | Mean % survival (days post start) | | | | | | | | Survival analysis[1] |
|---|---|---|---|---|---|---|---|---|---|
| | 0 | 1 | 2 | 3 | 4 | 5 | 6 | 7 | |
| diet only | 100 | 100 | 96 | 90 | 86 | 78 | 78 | 78 | − |
| 1 µg/µl | 100 | 84 | 80 | 44 | 26 | 8 | 6 | 6 | + |
| 0.2 µg/µl | 100 | 84 | 60 | 12 | 8 | 4 | 2 | 2 | + |
| 0.08 µg/µl | 100 | 84 | 62 | 18 | 14 | 6 | 6 | 6 | + |
| 0.04 µg/µl | 100 | 84 | 48 | 24 | 22 | 22 | 22 | 22 | + |

[1] = Data were analysed using Kaplan-Meier survival curve analysis

| | Chi squared | P value | Sig. Dif.[2] |
|---|---|---|---|
| diet versus: | | | |
| NL002 1 µg/µl | 57.53 | <0.0001 | Yes |
| NL002 0.2 µg/µl | 74.54 | <0.0001 | Yes |
| NL002 0.08 µg/µl | 64 | <0.0001 | Yes |
| NL002 0.04 µg/µl | 39.49 | <0.0001 | Yes |

[2] alpha <0.05

TABLE 12

Densities of CPB larvae on and percent defoliation of "LD010" and "Control" spray-treated potato under field conditions (2008) in (a) Hamburg, Pennsylvania, and (b) Jerome, Idaho.

(a)

| Treatment | No. of CPB larvaea | | | | % defoliation | | |
|---|---|---|---|---|---|---|---|
| | 0 DAT | 4 DAT | 6 DAT | 12 DAT | 1 DAT | 6 DAT | 14 DAT |
| Untreated | 173.8 | 219.5 | 312.5 | 171.3 | 2.8 | 16.8 | 16.0 |
| Admire | 218.3 | 268.8 | 347.8 | 235.0 | 4.0 | 18.8 | 22.5 |

TABLE 12-continued

Densities of CPB larvae on and percent defoliation of "LD010" and "

16. The composition of claim 12, wherein said at least one bacterial or yeast cell further comprises or further expresses at least one pesticidal agent selected from the group consisting of a *Bacillus thuringiensis* insecticidal protein, a *Xenorhabdus* insecticidal protein, a *Photorhabdus* insecticidal protein, a *Bacillus laterosporous* insecticidal protein, and a *Bacillus sphearicus* insecticidal protein.

17. A composition of claim 9, further comprising at least one further bacterial or yeast cell comprising or expressing at least one pesticidal agent selected from the group consisting of a *Bacillus thuringiensis* insecticidal protein, a *Xenorhabdus* insecticidal protein, a *Photorhabdus* insecticidal protein, a *Bacillus laterosporous* insecticidal protein, and a *Bacillus sphearicus* insecticidal protein.

18. The composition of any of claims 14-17 wherein said *Bacillus thuringiensis* insecticidal protein is selected from the group consisting of a Cry1, a Cry3, a TIC851, a CryET170, a Cry22, a binary insecticidal protein CryET33 and CryET34, a binary insecticidal protein CryET80 and CryET76, a binary insecticidal protein TIC100 and TIC101, and a binary insecticidal protein PS149B1.

19. The composition according to claim 9 formulated as a spray and optionally further comprising at least one adjuvant and at least one surfactant.

20. The composition according to claim 13 formulated as a spray and optionally further comprising at least one adjuvant and at least one surfactant.

21. A housing or trap or bait for a pest comprising a double stranded polyribonucleotide as defined in claim 1.

22. A method for killing or inhibiting growth of an insect chosen from the group comprising *Leptinotarsa* spp., optionally *L. decemlineata* (Colorado potato beetle), *L. juncta* (false potato beetle), and *L. texana* (Texan false potato beetle), comprising contacting the insect with a composition according to claim 9.

23. A method for reducing insect growth on a plant or for reducing insect infestation of a plant comprising applying to the plant an effective amount of a composition of claim 9.

24. A method for improving yield, comprising applying to a plant an effective amount of a composition of claim 9.

25. The method of claim 23 or claim 24 wherein said plant is chosen from the group comprising alfalfa, apple, apricot, artichoke, asparagus, avocado, banana, barley, beans, beet, blackberry, blueberry, broccoli, Brussels sprouts, cabbage, canola, carrot, cassava, cauliflower, a cereal, celery, cherry, citrus, clementine, coffee, corn, cotton, cucumber, eggplant, endive, eucalyptus, figs, grape, grapefruit, groundnuts, ground cherry, kiwifruit, lettuce, leek, lemon, lime, pine, maize, mango, melon, millet, mushroom, nut, oat, okra, onion, orange, an ornamental plant or flower or tree, papaya, parsley, pea, peach, peanut, peat, pepper, persimmon, pineapple, plantain, plum, pomegranate, potato, pumpkin, radicchio, radish, rapeseed, raspberry, rice, rye, sorghum, soy, soybean, spinach, strawberry, sugarbeet, sugarcane, sunflower, sweet potato, tangerine, tea, tobacco, tomato, a vine, watermelon, wheat, yams and zucchini.

26. The method of claim 23 or claim 24 wherein said insect is selected from the group comprising *Leptinotarsa* spp., optionally *L. decemlineata* (Colorado potato beetle), *L. juncta* (false potato beetle), or *L. texana* (Texan false potato beetle).

27. The method of claim 23 or claim 24, wherein said composition is topically applied to said plant, optionally wherein said composition is sprayed on said plant.

28. A method for reducing insect growth on a substrate comprising applying a composition of claim 9 to said substrate.

29. The composition of any of claim 3, 19 or 20, wherein the adjuvant comprises alkylphenyl Ω hydroxy-polyoxyethylene, polymerized resins and fatty acids.

30. The composition of claim 9 or claim 12 comprising between about $10^8$ and $10^{11}$ bacteria per milliliter.

\* \* \* \* \*

SEQUENCE LISTING (2495 sequences)

SEQ ID NO: 1 - DNA, 437 bp, Leptinotarsa decemlineata
ggccccaagaagcatttgaagcgtttgaatgccccaaaagcatggatgttggataaattgggaggtgttttcgcacctcgcccatctacaggacctcacaaattgcgagagtctttgcccttggtgatcttcctacgtaaccgattgaagtatgctttgactaacagcgaagttactaagattgttatgcaaaggttaatcaaagtagatggaaaagtgaggaccgactccaattaccctgctgggtttatggatgttattaccattgaaaaaactggtgaatttttccgactcatctatgatgttaaaggacgatttgcagtgcatcgtattactgctgaggaagcaaagtacaaactatgcaaagtcaggaggatgcaaactggccccaaaggaattcccttcatagtgacacacgacggccgcaccatccgcta

SEQ ID NO: 2 - protein, 145 aa, Leptinotarsa decemlineata
GPKKHLKRLNAPKAWMLDKLGGVFAPRPSTGPHKLRESLPLVIFLRNRLKYALTNSEVTKIVMQRLIKVDGKVRTDSNYPAGFMDVITIEKTGEFFRLIYDVKGRFAVHRITAEEAKYKLCKVRRMQTGPKGIPFIVTHDGRTIR

SEQ ID NO: 3 - DNA, 220 bp, Leptinotarsa decemlineata
gcaatgtcatccatcatgtcgtgtacattgtccacgtccaagtttttatgggctttcttaagagcttcagctgcatttttcatagattccaatactgtggtgttcgtactagctccctccagagcttctcgttgaagttcaatagtagttaaagtgccatctatttgcaactgatttttttctaatcgcttcttccgcttcagcgcttgcatggccgctc

SEQ ID NO: 4 - protein, 71 aa, Leptinotarsa decemlineata
AMQALKRKKRLEKNQLQIDGTLTTIELQREALEGASTNTTVLESMKNAAEALKKAHKNLDVDNVHDMMDDI

SEQ ID NO: 5 - DNA, 490 bp, Leptinotarsa decemlineata
caggttcttcctcttgacgcgtccagggcgaccaccaccgaatggagatttgagcgagaagtcaatatgcttctgggaatcaagtctcacaatgaagcttggaatattcacgacctgcttacgaaccctgatatgtctttgacggaccagcacacgagcatgatggattgattttgcaagccccaacttgaaaacttgtgtttggagacgtcgttccaagaaatcttcaatcttcaaacccaagacgtaatcaagcttcatacgggtttcatccaacactccaatacgcaccaaccgacgaagaagagcattgccttcaaacaacctgcgctgatctttctcttccaaagtcagaagttctctggcagctttacggatttttgccaaggtatacttgactcgccacacttcacgtttgttcctaagaccatattctcctatgattttcaactcctgatcaagacgtgccttttcataaggtcgcctggga

SEQ ID NO: 6 - protein, 163 aa, Leptinotarsa decemlineata
PRRPYEKARLDQELKIIGEYGLRNKREVWRVKYTLAKIRKAARELLTLEEKDQRRLFEGNALLRRLVRIGVLDETRMKLDYVLGLKIEDFLERRLQTQVFKLGLAKSIHHARVLVRQRHIRVRKQVVNIPSFIVRLDSQKHIDFSLKSPFGGGRPGRVKRKNL

SEQ ID NO: 7 - DNA, 561 bp, Leptinotarsa decemlineata
ggagcgagactacacaactatggctggcaggtgttggttgcttctggtgtggtggaatacatcgacactcttgaagaagaaactgtcatgattgcgatgaatcctgaggatcttcggcaggacaaagaatatgcttattgtacgacctacacccactgcgaaatccacccggccatgatcttgggcgtttgcgcgtctattatacctttccccgatcataaccagagcccaaggaacacctaccagagcgctatgggtaagcaagctatgggggtctacattacgaatttccacgtgcggatggacaccctggcccacgtgctatactacccgcacaaacctctggtcactaccaggtctatggagtatctgcggttcagagaattaccagccgggatcaacagtatagttgctattgcttgttatactggttataatcaagaagattctgttattctgaacgcgtctgctgtggaaagaggatttttccgatccgtgttttatcgttcctataaagatgccgaatcgaagcgaattggcgatcaagaagagcagttcgag

SEQ ID NO: 8 - protein, 183 aa, Leptinotarsa decemlineata
HNYGWQVLVASGVVEYIDTLEEETVMIAMNPEDLRQDKEYAYCTTYTHCEIHPAMILGVCASIIPFPDHNQSPRNTYQSAMGKQAMGVYITNFHVRMDTLAHVLYYPHKPLVTTRSMEYLRFRELPAGINSIVAIACYTGYNQEDSVILNASAVERGFFRSVFYRSYKDAESKRIGDQEEQFE

SEQ ID NO: 9 - DNA, 1031 bp, Leptinotarsa decemlineata
ccgaagaaggatgtgaagggtacttacgtatccatacacagttcaggcttcagagattttttattgaaaccagaaattctaagagctatagttgactgcggttttgaacacccttcagaagttcagcacgaatgtattcctcaagctgtcattggcatggacattttatgtcaagccaaatctggtatgggcaaaacggcagtgtttgttctggcgacactgcaacaattggaaccagcggacaatgttgtttacgttttggtgatgtgtcacactcgtgaactggctttccaaatcagcaaagagtacgagaggttcagtaaatatatgcccagtgtcaaggtgggcgtctttttcggaggaatgcctattgctaacgatgaagaagtattgaaaaacaaatgtccacacattgttgtggggacgcctgggcgtattttggcgcttgtcaagtctaggaagctagtcctcaagaacctgaaacacttcattcttgatgagtgcgataaaatgttagaactgttggatatgaggagagacgtccaggaaatctacagaaacacccctcacaccaagcaagtgatgatgttcagtgccacactcagcaaagaaatcaggccggtgtgcaagaaattcatgcaagatccaatggaggtgtatgtagacgatgaagccaaattgacgttgcacggattacaacagcattacgttaaactcaaagaaaatgaaaagaataaaaaattatttgagttgctcgatgttctcgaatttaatcaggtggtcatttttgtgaagtccgttcaaaggtgtgtggctttggcacagttgctgactgaacagaatttcccagccataggaattcacagaggaatggaccagaaagagaggttgtctcggtatgagcagttcaaagatttccagaagagaatattggtagctacgaatctctttgggcgtggcatggacattgaaagggtcaacattgtcttcaactatgatatgccagaggactccgacacctacttgcatcg

SEQ ID NO: 10 - protein, 343 aa, Leptinotarsa decemlineata
PKKDVKGTYVSIHSSGFRDFLLKPEILRAIVDCGFEHPSEVQHECIPQAVIGMDILCQAKSGMGKTAVFVLATLQQLEPADNVVYVLVMCHTRELAFQISKEYERFSKYMPSVKVGVFFGGMPIANDEEVLKNKCPHIVVGTPGRILALVKSRKLVLKNLKHFILDECDKMLELLDMRRDVQEIYRNTPHTKQVMMFSATLSKEIRPVCKKFMQDPMEVYVDDEAKLTLHGLQQHYVKLKENEKNKKLFELLDVLEFNQVVIFVKSVQRCVALAQLLTEQNFPAIGIHRGMDQKERLSRYEQFKDFQKRILVATNLFGRGMDIERVNIVFNYDMPEDSDTYLH

SEQ ID NO: 11 - DNA, 1601 bp, Leptinotarsa decemlineata
ctctcaaggattcgttgcagatgtctttgagcttgttgcccccgaatgccttgatagggttgattacctttgggaagatggtccaagtgcacgaactaggtaccgagggctgcagcaaatcttacgttttccgagggacgaaagacctcacagctaagcaagttcaagagatgttggaagtgggcagagccgcagtaagtgctcaacctgctcctcaacaaccaggacaacccatgaggcctggagcactccagcaagctcctacgccaccaggaagcaggttccttcaacccatctcgaaatgcgacatgaacctcactgatcttattggagagttgcaaagagacccatggcctgtccaccaaggcaaatgcgcccttagatcgaccgggacagctttatcgatagccattgggttgttggagtgcacatacgccaatactggtgccagggtcatgctattcgttggaggaccttgctctcaaggccctggtcaagtcttgaatgatgatctgaagcaacctatcagatctcaccacgacatccaaaaagacaatgccaaatacatgaagaaagcaatcaagcactatgataatttagcgatgagagcagcaacgaatggccactgcgttgacatatattcatgcgctttggatcagacaggattgatggagatgaaacagtgttgtaattcaacagggggacatatggtcatgggcgactcgttcaattcttccctgttcaagcaaacgttccagcgcatattttcgaaagatcagaaaaacgagctgaagatggcatttaatggtactctggagggtcaagtgttccagggagttgaaaattcaaggcggtattggatcttgtgtttcgttgaatgtgaagaatcctttggtttccgacaccgaaataggaatgggtaacacggtccagtggaaaatgtgtacggtaactccaagtactaccatggccttgttcttcgaggtcgtcaaccaacattccgctcccatacctcaagggggaaggggctgcatacagttcatcacgcaatatcagcatgctagtggccagaagaggatccgagtaacgacagttgctagaaactgggccgatgcttccgctaatatacatcatgtcagtgctggattcgatcaggaggcagccgcagtgataatggcgaggatggcagtttacagagcggaatcagacgatagccctgatgttttgagatgggtcgataggatgttgatacgtctgtgccagaaattcggcgaatataacaaggacgacccgaattcgttccgcttgggcgaaaacttcagcctctacccgcagttcatgtaccatttgagaaggtcacagttcctgcaggtgtttaacaattctcccgacgaaacgtccttctacaggcacatgcttatgcgcgaagacctcacgcagtcgctgatcatgatccagccgatactctacagctacagtttcaatggaccaccagaacctgtgcttttggatacgagttccatccaacccgatagaattctgctcatggacacgttcttccagattctgatattccatggcgaaaccatcgcccaatggcg

SEQ ID NO: 12 - protein, 260 aa, Leptinotarsa decemlineata
VKCSRELKIQGGIGSCVSLNVKNPLVSDTEIGMGNTVQWKMCTVTPSTTMALFFEVVNQHSAPIPQGGRGCIQFITQYQHASGQKRIRVTTVARNWADASANIHHVSAGFDQEAAAVIMARMAVYRAESDDSPDVLRWVDRMLIRLCQKFGEYNKDDPNSFRLGENFSLYPQFMYHLRRSQFLQVFNNSPDETSFYRHMLMREDLTQSLIMIQPILYSYSFNGPPEPVLLDTSSIQPDRILLMDTFFQILIFHGETIAQW

SEQ ID NO: 13 - DNA, 529 bp, Leptinotarsa decemlineata
gtggaagcagggctggcatggcgacaaattctagattgggatcaccaataagcttcctagctagccataggaaaggcttctcaaagttgtagttagatttggcagagatatcatagtactgcaaattcttcttcctatgaaagacaatacttttcgcttttacttttctgtctttgatgtcaaccttgttcccgcaaagtactatcgggatattttcacagactctgacaagatctctgtgccaatttggtacattcttgtatgtaactctggaagttacatcaaacatgataatagcacactgtccctgaatgtaatatccatcacggagaccaccaaacttctcctgaccggcagtgtcccatacattgaaccgaatagggcccctgtttgtatggaagaccagaggatggacttcaactcccaaagtagctacatatcttttttcaaattcaccagtcatatgacgtttcacaaatgtcgtttttccagtacctccatctccgaccaacacacacttgaaagtggg

SEQ ID NO: 14 - protein, 176 aa, Leptinotarsa decemlineata
PTFKCVLVGDGGTGKTTFVKRHMTGEFEKRYVATLGVEVHPLVFHTNRGPIRFNVWDTAGQEKFGGLRDGYYIQGQCAIIMFDVTSRVTYKNVPNWHRDLVRVCENIPIVLCGNKVDIKDRKVKAKSIVFHRKKNLQYYDISAKSNYNFEKPFLWLARKLIGDPNLEFVAMPALLP

SEQ ID NO: 15 - DNA, 607 bp, Leptinotarsa decemlineata
cgcagatcaagcatatgatggctttcattgaacaagaggcaaacgaaaaggcagaagaaatcgatgccaaggccgaggaagaatttaatattgaaaaggggcgccttgttcagcaacaacgtctcaagattatggaatattatgagaagaaagagaaacaggtcgaactccagaaaaaaatccaatcgtctaacatgttgaatcaggctcgattgaaagtattgaaggttagggaagatcacgttcgtaccgtactagaggaggcgcgtaaacgacttggtcaggtcacaaacgaccagggaaaatattcccaaatcctggaaagcctcattttgcagggattatatcagctttttgagaaagatgttaccattcgagttcggccccaggaccgagaactggtcaaatccatcattcccaccgtcacgaacaagtataaagatgccaccggtaaggacatccatctgaaaattgatgacgaaatccatctgtcccaagaaaccaccgggggaatcgacctgctggcgcagaaaaacaaaatcaagatcagcaatactatggaggctcgtctggagctgatttcgcagcaacttctgcccgagatccg

SEQ ID NO: 16 - protein, 201 aa, Leptinotarsa decemlineata
QIKHMMAFIEQEANEKAEEIDAKAEEEFNIEKGRLVQQQRLKIMEYYEKKEKQVELQKKIQSSNMLNQARLKVLKVREDHVRTVLEEARKRLGQVTNDQGKYSQILESLILQGLYQLFEKDVTIRVRPQDRELVKSIIPTVTNKYKDATGKDIHLKIDDEIHLSQETTGGIDLLAQKNKIKISNTMEARLELISQQLLPEI

SEQ ID NO: 17 - DNA, 257 bp, Leptinotarsa decemlineata
gcaatggcatcaagttcatcgatgaagatgatcgccggagagtttttgtcagcttcttcaaaagctttgcgcaagttactctcagactcgccagcgagtttgctcatgatctccggcccgtttatcaagaagaagaacgccccagtctcattagccacggcgcgagcaatcagggtcttacccgtaccagggggaccatacagcagtatacccctagggggcttcacgccgatagccttgaagagcgatggatggcg

SEQ ID NO: 18 - protein, 85 aa, Leptinotarsa decemlineata
RHPSLFKAIGVKPPRGILLYGPPGTGKTLIARAVANETGAFFFLINGPEIMSKLAGESESNLRKAFEEADKNSPAIIFIDELDAI

SEQ ID NO: 19 - DNA, 957 bp, Leptinotarsa decemlineata
ggaataggatgggtaatgtcgtcgttgggcatagtcaatataggaatctgggtgatggatccgttacgtccttcaacacggccggcacgttcatagatggtagctaaatcggtgtacatgtaacctgggaaaccacgacgaccaggcacctcttctctggcagcagatacctcacgcaaagcttctgcatacgaagacatatctgtcaagatgaccaagacgtgcttctcacattggtaagccaagaattcggcagctgtcaaagccagacgaggtgtaataattctttcaatggtaggatcgttggccaaattcaagaacaggcagacattctccatagaaccgttctcttcgaaatcctgtttgaagaacctagctgtttccatgttaacacccatagcagcgaaaacaatagcaaagttatcttcatgatcatcaagtacagatttaccaggaatcttgactaaaccagcctgtctacagatctgggcagcaatttcattgtgaggcagaccagctgcagagaaaatggggatcttctgaccacgagcaatggagttcatcacgtcaatagctgtaatacccgtctggatcatttcctcaggatagatacgggaccacggattgattggttgaccctggatgtccaagaagtcttcagccaaaattgggggacctttgtcgatgggttttcctgatccattgaaaacacgtcccaacatatcttcagaaacaggagtcctcaaaatatctcctgtgaattcacaagcggtgtttttggcgtcgattcctgatgtgccctcgaacacttgaaccacagcttttgacccactgacttccagaacttgtcccgaacgtatagtgccatcagccagtttgagttgtacgatttcattgtacttggggaacttaacatcttcgaggattaccagaggaccgttcacaccagacacagtc

SEQ ID NO: 20 - protein, 318 aa, Leptinotarsa decemlineata
TVSGVNGPLVILEDVKFPKYNEIVQLKLADGTIRSGQVLEVSGSKAVVQVFEGTSGIDAKNTACEFTGDILRTPVSEDMLGRVFNGSGKPIDKGPPILAEDFLDIQGQPINPWSRIYPEEMIQTGITAIDVMNSIARGQKIPIFSAAGLPHNEIAAQICRQAGLVKIPGKSVLDDHEDNFAIVFAAMGVNMETARFFKQDFEENGSMENVCLFLNLANDPTIERIITPRLALTAAEFLAYQCEKHVLVILTDMSSYAEALREVSAAREEVPGRRGFPGYMYTDLATIYERAGRVEGRNGSITQIPILTMPNDDITHPI

SEQ ID NO: 21 - DNA, 789 bp, Leptinotarsa decemlineata
cacctggttcaaggatgggcagcggataacggagtcgcagaaatacgagagcaccttctcgaacaaccaagcctccttgagggtaaaacaagcccagtctgaggactcgggacactacactttgttggcggagaaccctcaaggctgcatagtgtcatctgcttacttagccatagaaccggtaaccacccaggaagggttgatccacgagtccaccttcaagcagcaacagaccgaaatggagcaaatcgacaccagcaagaccttggcgcctaacttcgtcagggtttgcggggatagagacgtgaccgagggcaagatgacccgcttcgactgtcgcgtcactggtcgtccttatccagacgtgacatggtacataaacggtcgacaagtcaccgacgaccacaaccacaagattttggttaacgaatccggaaaccatgccctgatgatcaccaccgtgagcaggaacgactcaggagtagtgacctgcgtcgccaggaacaagacgggagaaacctccttccagtgcaaccttaacgtcatcgaaaaggaacaggtagtcgcgcccaagttcgtggagagatttaccacagtcaacgtggcagaaggagaaccagtgtctctgcgcgctagagctgttggcacgccggtgccgcgaatcacttggcagagggacggggcgcccctagccagcgggcccgacgttcgcatcgcgattgacggtggagcctctactttgaatatctcgagggccaaggcctcggatgctgcatggtaccgatgcac

SEQ ID NO: 22 - protein, 262 aa, Leptinotarsa decemlineata
TWFKDGQRITESQKYESTFSNNQASLRVKQAQSEDSGHYTLLAENPQGCIVSSAYLAIEPVTTQEGLIHESTFKQQQTEMEQIDTSKTLAPNFVRVCGDRDVTEGKMTRFDCRVTGRPYPDVTWYINGRQVTDDHNHKILVNESGNHALMITTVSRNDSGVVTCVARNKTGETSFQCNLNVIEKEQVVAPKFVERFTTVNVAEGEPVSLRARAVGTPVPRITWQRDGAPLASGPDVRIAIDGGASTLNISRAKASDAAWYRC

SEQ ID NO: 23 - DNA, 1033 bp, Leptinotarsa decemlineata
ccatggtggcgataaaccatacttgatatcgggagcagacgatcggttggttaaaatctgggactatcaaaacaaaacgtgtgtccaaaccttggaaggacacgcccaaaacgtaaccgcggtttgtttccaccctgaactacctgtggctctcacaggcagcgaagatggtaccgttagagtttggcatacgaatacacacagattagagaattgtttgaattatgggttcgagagagtgtggaccatttgttgcttgaagggttcgaataatgtttctctggggtatgacgagggcagtatattagtgaaagttggaagagaagaaccggcagttagtatggatgccagtggcggtaaaataatttgggcaaggcactcggaattacaacaagctaatttgaaggcgctgccagaaggtggagaaataagagatggggagcgtttacctgtctctgtaaaagatatgggagcatgtgaaatataccctcaaacaatccaacataatccgaatggaagattcgttgtagtatgcggagacggcgaatatatcatttacacagcgatggctctacggaacaaggcttttggaagcgctcaagagtttgtctgggctcaggactccagcgagtatgccattcgcgagtctggttccacaattcggatattcaaaaacttcaaagaaaggaagaacttcaagtcggatttcagcgcggaaggaatctacgggggttttctcttggggattaaatcggtgtccggtttaacgttttacgattgggaaactttggacttggtgagacggattgaaatacaaccgagggcggtttattggtctgacagtggaaaattagtctgtctcgcaacggaggacagctacttcatcctttcttatgattcggagcaagttcagaaggccagggagaacaatcaagtcgcagaggatggcgtagaggccgctttcgatgtgttgggggaaatgaacgagtctgtccgaacaggtctttgggtcggagactgtttcatctatacc

SEQ ID NO: 24 - protein, 344 aa, Leptinotarsa decemlineata
HGGDKPYLISGADDRLVKIWDYQNKTCVQTLEGHAQNVTAVCFHPELPVALTGSEDGTVRVWHTNTHRLENCLNYGFERVWTICCLKGSNNVSLGYDEGSILVKVGREEPAVSMDASGGKIIWARHSELQQANLKALPEGGEIRDGERLPVSVKDMGACEIYPQTIQHNPNGRFVVVCGDGEYIIYTAMALRNKAFGSAQEFVWAQDSSEYAIRESGSTIRIFKNFKERKNFKSDFSAEGIYGGFLLGIKSVSGLTFYDWETLDLVRRIEIQPRAVYWSDSGKLVCLATEDSYFILSYDSEQVQKARENNQVAEDGVEAAFDVLGEMNESVRTGLWVGDCFIYT

SEQ ID NO: 25 - DNA, 23 bp, Artificial Sequence
  primer forward
ggccccaagaagcatttgaagcg

SEQ ID NO: 26 - DNA, 23 bp, Artificial Sequence
  primer reverse
tagcggatggtgcgdccrtcrtg

SEQ ID NO: 27 - DNA, 29 bp, Artificial Sequence
  primer forward
gagcggccatgcaagcvctbaarmrraag

SEQ ID NO: 28 - DNA, 26 bp, Artificial Sequence
  primer reverse
gcaatgtcatccatcakrtcrtgcac

SEQ ID NO: 29 - DNA, 26 bp, Artificial Sequence
  primer forward
  misc_feature (18)..(18): n is a, c, g, or t
tcggtcttctcgaagacntaygtkac

SEQ ID NO: 30 - DNA, 24 bp, Artificial Sequence
  primer reverse
caggttcttcctcttkacrcgdcc

SEQ ID NO: 31 - DNA, 29 bp, Artificial Sequence
  primer forward
ggagcgagactacaacaaykayrgytggc

SEQ ID NO: 32 - DNA, 24 bp, Artificial Sequence
  primer reverse
ctcgaactgctcytcytgatcrcc

SEQ ID NO: 33 - DNA, 23 bp, Artificial Sequence
  primer forward
ccgaagaaggaygtsaagggyac

SEQ ID NO: 34 - DNA, 26 bp, Artificial Sequence
  primer reverse
cgatgcaagtaggtgtckgartcytc

SEQ ID NO: 35 - DNA, 25 bp, Artificial Sequence
  primer forward
ctctcaaggattckytrcaratgtc

SEQ ID NO: 36 - DNA, 23 bp, Artificial Sequence
  primer reverse
cgccattgggcratggtytckcc

SEQ ID NO: 37 - DNA, 26 bp, Artificial Sequence
  primer forward
cccactttcaagtgygtrytrgtcgg

SEQ ID NO: 38 - DNA, 25 bp, Artificial Sequence
  primer reverse
gtggaagcagggcwggcatkgcrac

SEQ ID NO: 39 - DNA, 22 bp, Artificial Sequence
  primer forward
cgcagatcaarcayatgatggc

SEQ ID NO: 40 - DNA, 21 bp, Artificial Sequence
  primer reverse
cggatctcgggcasmarytgc

SEQ ID NO: 41 - DNA, 23 bp, Artificial Sequence
  primer forward
cgccatccrtcgctsttcaaggc

SEQ ID NO: 42 - DNA, 24 bp, Artificial Sequence
  primer reverse
gcaatggcatcaakytcrtcratg

SEQ ID NO: 43 - DNA, 24 bp, Artificial Sequence
  primer forward
gactgtgtctggtgtraacggwcc

SEQ ID NO: 44 - DNA, 24 bp, Artificial Sequence
  primer reverse
ggaataggatgggtratrtcgtcg

SEQ ID NO: 45 - DNA, 24 bp, Artificial Sequence
  primer forward
cacctggttcaagratggvcarmg

SEQ ID NO: 46 - DNA, 23 bp, Artificial Sequence
  primer reverse
gtgcatcggtaccahschgcrtc

SEQ ID NO: 47 - DNA, 22 bp, Artificial Sequence
  primer forward
ccatggtggcgayaarccvtac

SEQ ID NO: 48 - DNA, 27 bp, Artificial Sequence
  primer reverse
ggtatagatgaarcartcdccvaccca

SEQ ID NO: 49 - DNA, 26 bp, Leptinotarsa decemlineata
ggccccaagaagcatttgaagcgttt

SEQ ID NO: 50 - DNA, 41 bp, Leptinotarsa decemlineata
aatgccccaaaagcatggatgttggataaattgggaggtgt

SEQ ID NO: 51 - DNA, 23 bp, Leptinotarsa decemlineata
gaagttactaagattgttatgca

SEQ ID NO: 52 - DNA, 26 bp, Leptinotarsa decemlineata
attgaaaaaactggtgaatttttccg

SEQ ID NO: 53 - DNA, 25 bp, Leptinotarsa decemlineata
acacacgacggccgcaccatccgct

SEQ ID NO: 54 - DNA, 26 bp, Leptinotarsa decemlineata
acacacgacggccgcaccatccgcta

SEQ ID NO: 55 - DNA, 24 bp, Leptinotarsa decemlineata
cccaagaagcatttgaagcgtttg

SEQ ID NO: 56 - DNA, 23 bp, Leptinotarsa decemlineata
gcaatgtcatccatcatgtcgtg

SEQ ID NO: 57 - DNA, 27 bp, Leptinotarsa decemlineata
caggttcttcctcttgacgcgtccagg

SEQ ID NO: 58 - DNA, 25 bp, Leptinotarsa decemlineata
ttgagcgagaagtcaatatgcttct

SEQ ID NO: 59 - DNA, 30 bp, Leptinotarsa decemlineata
ttccaagaaatcttcaatcttcaaacccaa

SEQ ID NO: 60 - DNA, 21 bp, Leptinotarsa decemlineata
ttcatccaacactccaatacg

SEQ ID NO: 61 - DNA, 24 bp, Leptinotarsa decemlineata
aagagcattgccttcaaacaacct

SEQ ID NO: 62 - DNA, 26 bp, Leptinotarsa decemlineata
agttctctggcagctttacggatttt

SEQ ID NO: 63 - DNA, 21 bp, Leptinotarsa decemlineata
ccacacttcacgtttgttcct

SEQ ID NO: 64 - DNA, 21 bp, Leptinotarsa decemlineata
ccgtatgaagcttgattacgt

SEQ ID NO: 65 - DNA, 23 bp, Leptinotarsa decemlineata
aggaacaaacgtgaagtgtggcg

SEQ ID NO: 66 - DNA, 26 bp, Leptinotarsa decemlineata
agcgctatgggtaagcaagctatggg

SEQ ID NO: 67 - DNA, 27 bp, Leptinotarsa decemlineata
tgttatactggttataatcaagaagat

SEQ ID NO: 68 - DNA, 23 bp, Leptinotarsa decemlineata
gaagttcagcacgaatgtattcc

SEQ ID NO: 69 - DNA, 27 bp, Leptinotarsa decemlineata
caagcaagtgatgatgttcagtgccac

SEQ ID NO: 70 - DNA, 23 bp, Leptinotarsa decemlineata
tgcaagaaattcatgcaagatcc

SEQ ID NO: 71 - DNA, 21 bp, Leptinotarsa decemlineata
aaatgaaaagaataaaaaatt

SEQ ID NO: 72 - DNA, 23 bp, Leptinotarsa decemlineata
cagaatttcccagccataggaat

SEQ ID NO: 73 - DNA, 23 bp, Leptinotarsa decemlineata
agcagttcaaagatttccagaag

SEQ ID NO: 74 - DNA, 24 bp, Leptinotarsa decemlineata
ttccaaatcagcaaagagtacgag

SEQ ID NO: 75 - DNA, 21 bp, Leptinotarsa decemlineata
tacccgcagttcatgtaccat

SEQ ID NO: 76 - DNA, 23 bp, Leptinotarsa decemlineata
cagtcgctgatcatgatccagcc

SEQ ID NO: 77 - DNA, 23 bp, Leptinotarsa decemlineata
ctcatggacacgttcttccagat

SEQ ID NO: 78 - DNA, 22 bp, Leptinotarsa decemlineata
ggggctgcatacagttcatcac

SEQ ID NO: 79 - DNA, 22 bp, Leptinotarsa decemlineata
cccgcagttcatgtaccatttg

SEQ ID NO: 80 - DNA, 23 bp, Leptinotarsa decemlineata
gacaatgccaaatacatgaagaa

SEQ ID NO: 81 - DNA, 24 bp, Leptinotarsa decemlineata
ttcgatcaggaggcagccgcagtg

SEQ ID NO: 82 - DNA, 23 bp, Leptinotarsa decemlineata
agcagggctggcatggcgacaaa

SEQ ID NO: 83 - DNA, 26 bp, Leptinotarsa decemlineata
ttctcaaagttgtagttagatttggc

SEQ ID NO: 84 - DNA, 23 bp, Leptinotarsa decemlineata
tactgcaaattcttcttcctatg

SEQ ID NO: 85 - DNA, 22 bp, Leptinotarsa decemlineata
ggtacattcttgtatgtaactc

SEQ ID NO: 86 - DNA, 23 bp, Leptinotarsa decemlineata
tcaaacatgataatagcacactg

SEQ ID NO: 87 - DNA, 24 bp, Leptinotarsa decemlineata
tctcctgaccggcagtgtcccata

SEQ ID NO: 88 - DNA, 26 bp, Leptinotarsa decemlineata
gctactttgggagttgaagtccatcc

SEQ ID NO: 89 - DNA, 27 bp, Leptinotarsa decemlineata
taactacaactttgagaagcctttcct

SEQ ID NO: 90 - DNA, 23 bp, Leptinotarsa decemlineata
aagtttggtggtctccgtgatgg

SEQ ID NO: 91 - DNA, 21 bp, Leptinotarsa decemlineata
gcagatcaagcatatgatggc

SEQ ID NO: 92 - DNA, 26 bp, Leptinotarsa decemlineata
atcaagcatatgatggctttcattga

SEQ ID NO: 93 - DNA, 23 bp, Leptinotarsa decemlineata
aatattgaaaaggggcgccttgt

SEQ ID NO: 94 - DNA, 23 bp, Leptinotarsa decemlineata
caacgtctcaagattatggaata

SEQ ID NO: 95 - DNA, 26 bp, Leptinotarsa decemlineata
attatggaatattatgagaagaaaga

SEQ ID NO: 96 - DNA, 24 bp, Leptinotarsa decemlineata
aacaaaatcaagatcagcaatact

SEQ ID NO: 97 - DNA, 22 bp, Leptinotarsa decemlineata
atgtcgtcgttgggcatagtca

SEQ ID NO: 98 - DNA, 41 bp, Leptinotarsa decemlineata
gtagctaaatcggtgtacatgtaacctgggaaaccacgacg

SEQ ID NO: 99 - DNA, 23 bp, Leptinotarsa decemlineata
gcagatacctcacgcaaagcttc

SEQ ID NO: 100 - DNA, 29 bp, Leptinotarsa decemlineata
ggatcgttggccaaattcaagaacaggca

SEQ ID NO: 101 - DNA, 32 bp, Leptinotarsa decemlineata
ttctccatagaaccgttctcttcgaaatcctg

SEQ ID NO: 102 - DNA, 23 bp, Leptinotarsa decemlineata
gctgtttccatgttaacacccat

SEQ ID NO: 103 - DNA, 25 bp, Leptinotarsa decemlineata
tccatgttaacacccatagcagcga

SEQ ID NO: 104 - DNA, 29 bp, Leptinotarsa decemlineata
ctacagatctgggcagcaatttcattgtg

SEQ ID NO: 105 - DNA, 23 bp, Leptinotarsa decemlineata
ggcagaccagctgcagagaaaat

SEQ ID NO: 106 - DNA, 47 bp, Leptinotarsa decemlineata
gagaaaatggggatcttctgaccacgagcaatggagttcatcacgtc

SEQ ID NO: 107 - DNA, 23 bp, Leptinotarsa decemlineata
atggagttcatcacgtcaatagc

SEQ ID NO: 108 - DNA, 98 bp, Leptinotarsa decemlineata
gtctggatcatttcctcaggatagatacgggaccacggattgattggttgaccctggatgtccaagaagtcttcagccaaaattgggggacctttgtc

SEQ ID NO: 109 - DNA, 23 bp, Leptinotarsa decemlineata
attgggggacctttgtcgatggg

SEQ ID NO: 110 - DNA, 140 bp, Leptinotarsa decemlineata
atgggttttcctgatccattgaaaacacgtcccaacatatcttcagaaacaggagtcctcaaaatatctcctgtgaattcacaagcggtgtttttggcgtcgattcctgatgtgccctcgaacacttgaaccacagcttt

SEQ ID NO: 111 - DNA, 26 bp, Leptinotarsa decemlineata
acagcttttgacccactgacttccag

SEQ ID NO: 112 - DNA, 57 bp, Leptinotarsa decemlineata
gacccactgacttccagaacttgtcccgaacgtatagtgccatcagccagtttgagt

SEQ ID NO: 113 - DNA, 23 bp, Leptinotarsa decemlineata
ggaccgttcacaccagacacagt

SEQ ID NO: 114 - DNA, 27 bp, Leptinotarsa decemlineata
gactgtgtctggtgtgaacggtcctct

SEQ ID NO: 115 - DNA, 23 bp, Leptinotarsa decemlineata
ttctcttcgaaatcctgtttgaa

SEQ ID NO: 116 - DNA, 24 bp, Leptinotarsa decemlineata
gactgtgtvtggtgtgaacggtcc

SEQ ID NO: 117 - DNA, 38 bp, Leptinotarsa decemlineata
ggtcgtcgtggtttcccaggttacatgtacaccgattt

SEQ ID NO: 118 - DNA, 22 bp, Leptinotarsa decemlineata
tgacagctgccgaattcttggc

SEQ ID NO: 119 - DNA, 26 bp, Leptinotarsa decemlineata
caagtcaccgacgaccacaaccacaa

SEQ ID NO: 120 - DNA, 21 bp, Leptinotarsa decemlineata
atcgcgattgacggtggagcc

SEQ ID NO: 121 - DNA, 22 bp, Leptinotarsa decemlineata
agacgatcggttggttaaaatc

SEQ ID NO: 122 - DNA, 23 bp, Leptinotarsa decemlineata
gatatgggagcatgtgaaatata

SEQ ID NO: 123 - DNA, 21 bp, Leptinotarsa decemlineata
ttagagaattgtttgaattat

SEQ ID NO: 124 - DNA, 21 bp, Leptinotarsa decemlineata
aagaagcatttgaagcgtttg

SEQ ID NO: 125 - DNA, 21 bp, Leptinotarsa decemlineata
gttcttcctcttgacgcgtcc

SEQ ID NO: 126 - DNA, 23 bp, Leptinotarsa decemlineata
gcagctttacggatttttgccaa

SEQ ID NO: 127 - DNA, 22 bp, Leptinotarsa decemlineata
tttcaactcctgatcaagacgt

SEQ ID NO: 128 - DNA, 23 bp, Leptinotarsa decemlineata
gctatgggtaagcaagctatggg

SEQ ID NO: 129 - DNA, 21 bp, Leptinotarsa decemlineata
aaagaataaaaaattatttga

SEQ ID NO: 130 - DNA, 23 bp, Leptinotarsa decemlineata
aagcaagtgatgatgttcagtgc

SEQ ID NO: 131 - DNA, 23 bp, Leptinotarsa decemlineata
atgatggctttcattgaacaaga

SEQ ID NO: 132 - DNA, 23 bp, Leptinotarsa decemlineata
aacgccccagtctcattagccac

SEQ ID NO: 133 - DNA, 21 bp, Leptinotarsa decemlineata
ttttggcgtcgattcctgatg

SEQ ID NO: 134 - DNA, 23 bp, Leptinotarsa decemlineata
gtgtacatgtaacctgggaaacc

SEQ ID NO: 135 - DNA, 29 bp, Leptinotarsa decemlineata
gtgtacatgtaacctgggaaaccacgacg

SEQ ID NO: 136 - DNA, 23 bp, Leptinotarsa decemlineata
tagcggatggtgcggccgtcgtg

SEQ ID NO: 137 - DNA, 25 bp, Leptinotarsa decemlineata
ttccaagaaatcttcaatcttcaaa

SEQ ID NO: 138 - DNA, 32 bp, Leptinotarsa decemlineata
gactgcggttttgaacacccttcagaagttca

SEQ ID NO: 139 - DNA, 23 bp, Leptinotarsa decemlineata
tgtcaagccaaatctggtatggg

SEQ ID NO: 140 - DNA, 21 bp, Leptinotarsa decemlineata
ggcttctcaaagttgtagtta

SEQ ID NO: 141 - DNA, 23 bp, Leptinotarsa decemlineata
ccatcacggagaccaccaaactt

SEQ ID NO: 142 - DNA, 24 bp, Leptinotarsa decemlineata
aaaggcttctcaaagttgtagtta

SEQ ID NO: 143 - DNA, 23 bp, Leptinotarsa decemlineata
tgtgctattatcatgtttgatgt

SEQ ID NO: 144 - DNA, 23 bp, Leptinotarsa decemlineata
actgccggtcaggagaagtttgg

SEQ ID NO: 145 - DNA, 25 bp, Leptinotarsa decemlineata
aatacaactttgagaagcctttcct

SEQ ID NO: 146 - DNA, 23 bp, Leptinotarsa decemlineata
caggagaagtttggtggtctccg

SEQ ID NO: 147 - DNA, 21 bp, Leptinotarsa decemlineata
accaccaaacttctcctgacc

SEQ ID NO: 148 - DNA, 25 bp, Leptinotarsa decemlineata
ggtcaggagaagttggtggtctccg

SEQ ID NO: 149 - DNA, 28 bp, Leptinotarsa decemlineata
gcagcaatttcattgtgaggcagaccag

SEQ ID NO: 150 - DNA, 23 bp, Leptinotarsa decemlineata
atggagttcatcacgtcaatagc

SEQ ID NO: 151 - DNA, 32 bp, Leptinotarsa decemlineata
ggtctgcctcacaatgaaattgctgcccagat

SEQ ID NO: 152 - DNA, 34 bp, Leptinotarsa decemlineata
ctattgttttcgctgctatgggtgttaacatgga

SEQ ID NO: 153 - DNA, 29 bp, Leptinotarsa decemlineata
atgaactccattgctcgtggtcagaagat

SEQ ID NO: 154 - DNA, 26 bp, Leptinotarsa decemlineata
ataggaatctgggtgatggatccgtt

SEQ ID NO: 155 - DNA, 24 bp, Leptinotarsa decemlineata
tcctgtttctgaagatatgttggg

SEQ ID NO: 156 - DNA, 27 bp, Leptinotarsa decemlineata
tttgaagattgaagatttcttggaacg

SEQ ID NO: 157 - DNA, 23 bp, Leptinotarsa decemlineata
tcacaggcagcgaagatggtacc

SEQ ID NO: 158 - DNA, 21 bp, Leptinotarsa decemlineata
ttctttgaagtttttgaatat

SEQ ID NO: 159 - DNA, 112 bp, Leptinotarsa decemlineata
tctagaatgttgaatcaggctcgattgaaagtattgaaggttagggaagatcacgttcgtaccgtactagaggaggcgcgtaaacgacttggtcaggtcacaaacgcccggg

SEQ ID NO: 160 - DNA, 72 bp, Leptinotarsa decemlineata
tctagaaagatcacgttcgtaccgtactagaggaggcgcgtaaacgacttggtcaggtcacaaacgcccggg

SEQ ID NO: 161 - DNA, 312 bp, Leptinotarsa decemlineata
tctagaatgttgaatcaggctcgattgaaagtattgaaggttagggaagatcacgttcgtaccgtactagaggaggcgcgtaaacgacttggtcaggtcacaaacgatgttgaatcaggctcgattgaaagtattgaaggttagggaagatcacgttcgtaccgtactagaggaggcgcgtaaacgacttggtcaggtcacaaacgatgttgaatcaggctcgattgaaagtattgaaggttagggaagatcacgttcgtaccgtactagaggaggcgcgtaaacgacttggtcaggtcacaaacgcccggg

SEQ ID NO: 162 - DNA, 312 bp, Leptinotarsa decemlineata
tctagaaagatcacgttcgtaccgtactagaggaggcgcgtaaacgacttggtcaggtcacaaacgaagatcacgttcgtaccgtactagaggaggcgcgtaaacgacttggtcaggtcacaaacgaagatcacgttcgtaccgtactagaggaggcgcgtaaacgacttggtcaggtcacaaacgaagatcacgttcgtaccgtactagaggaggcgcgtaaacgacttggtcaggtcacaaacgaagatcacgttcgtaccgtactagaggaggcgcgtaaacgacttggtcaggtcacaaacgcccggg

SEQ ID NO: 163 - DNA, 395 bp, Leptinotarsa decemlineata
ggccccaagaagcatttgaagcgtttgaatgccccaaaagcatggatgttggataaattgggaggtgttttcgcacctcgcccatctacaggacctcacaaattgcgagagtctttgcccttggtgatcttcctacgtaaccgattgaagtatgctttgactaacagcgaagttactaagattgttatgcaaaggttaatcaaagtagatggaaaagtgaggaccgactccaattaccctgctgggtttatggatgttattaccattgaaaaaactggtgaatttttccgactcatctatgatgttaaaggacgatttgcagtgcatcgtattactgctgaggaagcaaagtacaaactatgcaaagtcaggaggatgcaaactggccccaaagg

SEQ ID NO: 164 - DNA, 45 bp, Artificial Sequence
  primer forward
gcgtaatacgactcactataggggccccaagaagcatttgaagcg

SEQ ID NO: 165 - DNA, 21 bp, Artificial Sequence
  primer reverse
cctttggggccagtttgcatc

SEQ ID NO: 166 - DNA, 23 bp, Artificial Sequence
  primer forward
ggccccaagaagcatttgaagcg

SEQ ID NO: 167 - DNA, 43 bp, Artificial Sequence
  primer reverse
gcgtaatacgactcactataggcctttggggccagtttgcatc

SEQ ID NO: 168 - DNA, 162 bp, Leptinotarsa decemlineata
gtccacgtccaagtttttatgggctttcttaagagcttcagctgcatttttcatagattccaatactgtggtgttcgtactagctccctccagagcttctcgttgaagttcaatagtagttaaagtgccatctatttgcaactgatttttttctaatcgctt

SEQ ID NO: 169 - DNA, 46 bp, Artificial Sequence
  primer forward
gcgtaatacgactcactatagggtccacgtccaagtttttatgggc

SEQ ID NO: 170 - DNA, 25 bp, Artificial Sequence
  primer reverse
aagcgattagaaaaaaatcagttgc

SEQ ID NO: 171 - DNA, 24 bp, Artificial Sequence
  primer forward
gtccacgtccaagtttttatgggc

SEQ ID NO: 172 - DNA, 47 bp, Artificial Sequence
  primer reverse
gcgtaatacgactcactataggaagcgattagaaaaaaatcagttgc

SEQ ID NO: 173 - DNA, 463 bp, Leptinotarsa decemlineata
ggtgaccaccaccgaatggagatttgagcgagaagtcaatatgcttctgggaatcaagtctcacaatgaagcttggaatattcacgacctgcttacgaaccctgatatgtctttgacggaccagcacacgagcatgatggattgattttgcaagccccaacttgaaaacttgtgtttggagacgtcgttccaagaaatcttcaatcttcaaacccaagacgtaatcaagcttcatacgggtttcatccaacactccaatacgcaccaaccgacgaagaagagcattgccttcaaacaacctgcgctgatctttctcttccaaagtcagaagttctctggcagctttacggatttttgccaaggtatacttgactcgccacacttcacgtttgttcctaagaccatattctcctatgattttcaactcctgatcaagacgtgccttttcataaggtcgcctggg

SEQ ID NO: 174 - DNA, 45 bp, Artificial Sequence
  synthetic oligo
gcgtaatacgactcactataggcccaggcgaccttatgaaaaggc

SEQ ID NO: 175 - DNA, 21 bp, Artificial Sequence
  synthetic oligo
ggtgaccaccaccgaatggag

SEQ ID NO: 176 - DNA, 23 bp, Artificial Sequence
  synthetic oligo
cccaggcgaccttatgaaaaggc

SEQ ID NO: 177 - DNA, 43 bp, Artificial Sequence
  synthetic oligo
gcgtaatacgactcactataggggtgaccaccaccgaatggag

SEQ ID NO: 178 - DNA, 503 bp, Leptinotarsa decemlineata
ggtgttggttgcttctggtgtggtggaatacatcgacactcttgaagaagaaactgtcatgattgcgatgaatcctgaggatcttcggcaggacaaagaatatgcttattgtacgacctacacccactgcgaaatccacccggccatgatcttgggcgtttgcgcgtctattatacctttccccgatcataaccagagcccaaggaacacctaccagagcgctatgggtaagcaagctatgggggtctacattacgaatttccacgtgcggatggacaccctggcccacgtgctatactacccgcacaaacctctggtcactaccaggtctatggagtatctgcggttcagagaattaccagccgggatcaacagtatagttgctattgcttgttatactggttataatcaagaagattctgttattctgaacgcgtctgctgtggaaagaggatttttccgatccgtgttttatcgttcctataaagatgccgaatcgaagc

SEQ ID NO: 179 - DNA, 44 bp, Artificial Sequence
  synthetic oligo
gcgtaatacgactcactataggggtgttggttgcttctggtgtg

SEQ ID NO: 180 - DNA, 24 bp, Artificial Sequence
  synthetic oligo
gcttcgattcggcatctttatagg

SEQ ID NO: 181 - DNA, 22 bp, Artificial Sequence
  synthetic oligo
ggtgttggttgcttctggtgtg

SEQ ID NO: 182 - DNA, 46 bp, Artificial Sequence
  synthetic oligo
gcgtaatacgactcactatagggcttcgattcggcatctttatagg

SEQ ID NO: 183 - DNA, 883 bp, Leptinotarsa decemlineata
gactggcggttttgaacacccttcagaagttcagcacgaatgtattcctcaagctgtcattggcatggacattttatgtcaagccaaatctggtatgggcaaaacggcagtgtttgttctggcgacactgcaacaattggaaccagcggacaatgttgtttacgttttggtgatgtgtcacactcgtgaactggctttccaaatcagcaaagagtacgagaggttcagtaaatatatgcccagtgtcaaggtgggcgtctttttcggaggaatgcctattgctaacgatgaagaagtattgaaaaacaaatgtccacacattgttgtggggacgcctgggcgtattttggcgcttgtcaagtctaggaagctagtcctcaagaacctgaaacacttcattcttgatgagtgcgataaaatgttagaactgttggatatgaggagagacgtccaggaaatctacagaaacacccctcacaccaagcaagtgatgatgttcagtgccacactcagcaaagaaatcaggccggtgtgcaagaaattcatgcaagatccaatggaggtgtatgtagacgatgaagccaaattgacgttgcacggattacaacagcattacgttaaactcaaagaaaatgaaaagaataaaaaattatttgagttgctcgatgttctcgaatttaatcaggtggtcatttttgtgaagtccgttcaaaggtgtgtggctttggcacagttgctgactgaacagaatttcccagccataggaattcacagaggaatggaccagaaagagaggttgtctcggtatgagcagttcaaagatttccagaagagaatattggtagctacgaatctctttgggcgtggcatggacattgaaagg

SEQ ID NO: 184 - DNA, 43 bp, Artificial Sequence
  synthetic oligo
gcgtaatacgactcactatagggactggcggttttgaacaccc

SEQ ID NO: 185 - DNA, 21 bp, Artificial Sequence
  synthetic oligo
cctttcaatgtccatgccacg

SEQ ID NO: 186 - DNA, 21 bp, Artificial Sequence
  synthetic oligo
gactggcggttttgaacaccc

SEQ ID NO: 187 - DNA, 43 bp, Artificial Sequence
  synthetic oligo
gcgtaatacgactcactataggcctttcaatgtccatgccacg

SEQ ID NO: 188 - DNA, 1505 bp, Leptinotarsa decemlineata
gcttgttgcccccgaatgccttgatagggttgattacctttgggaagatggtccaagtgcacgaactaggtaccgagggctgcagcaaatcttacgttttccgagggacgaaagacctcacagctaagcaagttcaagagatgttggaagtgggcagagccgcagtaagtgctcaacctgctcctcaacaaccaggacaacccatgaggcctggagcactccagcaagctcctacgccaccaggaagcaggttccttcaacccatctcgaaatgcgacatgaacctcactgatcttattggagagttgcaaagagacccatggcctgtccaccaaggcaaatgcgcccttagatcgaccgggacagctttatcgatagccattgggttgttggagtgcacatacgccaatactggtgccagggtcatgctattcgttggaggaccttgctctcaaggccctggtcaagtcttgaatgatgatctgaagcaacctatcagatctcaccacgacatccaaaaagacaatgccaaatacatgaagaaagcaatcaagcactatgataatttagcgatgagagcagcaacgaatggccactgcgttgacatatattcatgcgctttggatcagacaggattgatggagatgaaacagtgttgtaattcaacagggggacatatggtcatgggcgactcgttcaattcttccctgttcaagcaaacgttccagcgcatattttcgaaagatcagaaaaacgagctgaagatggcatttaatggtactctggagggtcaagtgttccagggagttgaaaattcaaggcggtattggatcttgtgtttcgttgaatgtgaagaatcctttggtttccgacaccgaaataggaatgggtaacacggtccagtggaaaatgtgtacggtaactccaagtactaccatggccttgttcttcgaggtcgtcaaccaacattccgctcccatacctcaagggggaaggggctgcatacagttcatcacgcaatatcagcatgctagtggccagaagaggatccgagtaacgacagttgctagaaactgggccgatgcttccgctaatatacatcatgtcagtgctggattcgatcaggaggcagccgcagtgataatggcgaggatggcagtttacagagcggaatcagacgatagccctgatgttttgagatgggtcgataggatgttgatacgtctgtgccagaaattcggcgaatataacaaggacgacccgaattcgttccgcttgggcgaaaacttcagcctctacccgcagttcatgtaccatttgagaaggtcacagttcctgcaggtgtttaacaattctcccgacgaaacgtccttctacaggcacatgcttatgcgcgaagacctcacgcagtcgctgatcatgatccagccgatactctacagctacagtttcaatggaccaccagaacctgtgcttttggatacgagttccatccaacccgatag

SEQ ID NO: 189 - DNA, 41 bp, Artificial Sequence
  synthetic oligo
gcgtaatacgactcactatagggcttgttgcccccgaatgc

SEQ ID NO: 190 - DNA, 22 bp, Artificial Sequence
  synthetic oligo
ctatcgggttggatggaactcg

SEQ ID NO: 191 - DNA, 19 bp, Artificial Sequence
  synthetic oligo
gcttgttgcccccgaatgc

SEQ ID NO: 192 - DNA, 44 bp, Artificial Sequence
  synthetic oligo
gcgtaatacgactcactataggctatcgggttggatggaactcg

SEQ ID NO: 193 - DNA, 427 bp, Leptinotarsa decemlineata
gccataggaaaggcttctcaaagttgtagttagatttggcagagatatcatagtactgcaaattcttcttcctatgaaagacaatacttttcgcttttacttttctgtctttgatgtcaaccttgttcccgcaaagtactatcgggatattttcacagactctgacaagatctctgtgccaatttggtacattcttgtatgtaactctggaagttacatcaaacatgataatagcacactgtccctgaatgtaatatccatcacggagaccaccaaacttctcctgaccggcagtgtcccatacattgaaccgaatagggcccctgtttgtatggaagaccagaggatggacttcaactcccaaagtagctacatatcttttttcaaattcaccagtcatatgacgtttcacaaatgtcgtttttcc

SEQ ID NO: 194 - DNA, 45 bp, Artificial Sequence
  synthetic oligo
gcgtaatacgactcactatagggccataggaaaggcttctcaaag

SEQ ID NO: 195 - DNA, 25 bp, Artificial Sequence
  synthetic oligo
ggaaaaacgacatttgtgaaacgtc

SEQ ID NO: 196 - DNA, 23 bp, Artificial Sequence
  synthetic oligo
gccataggaaaggcttctcaaag

SEQ ID NO: 197 - DNA, 47 bp, Artificial Sequence
  synthetic oligo
gcgtaatacgactcactataggggaaaaacgacatttgtgaaacgtc

SEQ ID NO: 198 - DNA, 563 bp, Leptinotarsa decemlineata
tttcattgaacaagaggcaaacgaaaaggcagaagaaatcgatgccaaggccgaggaagaatttaatattgaaaaggggcgccttgttcagcaacaacgtctcaagattatggaatattatgagaagaaagagaaacaggtcgaactccagaaaaaaatccaatcgtctaacatgttgaatcaggctcgattgaaagtattgaaggttagggaagatcacgttcgtaccgtactagaggaggcgcgtaaacgacttggtcaggtcacaaacgaccagggaaaatattcccaaatcctggaaagcctcattttgcagggattatatcagctttttgagaaagatgttaccattcgagttcggccccaggaccgagaactggtcaaatccatcattcccaccgtcacgaacaagtataaagatgccaccggtaaggacatccatctgaaaattgatgacgaaatccatctgtcccaagaaaccaccgggggaatcgacctgctggcgcagaaaaacaaaatcaagatcagcaatactatggaggctcgtctggagctgatttcgc

SEQ ID NO: 199 - DNA, 45 bp, Artificial Sequence
  synthetic oligo
gcgtaatacgactcactataggtttcattgaacaagaggcaaacg

SEQ ID NO: 200 - DNA, 22 bp, Artificial Sequence
  synthetic oligo
gcgaaatcagctccagacgagc

SEQ ID NO: 201 - DNA, 23 bp, Artificial Sequence
  synthetic oligo
tttcattgaacaagaggcaaacg

SEQ ID NO: 202 - DNA, 44 bp, Artificial Sequence
  synthetic oligo
gcgtaatacgactcactatagggcgaaatcagctccagacgagc

SEQ ID NO: 203 - DNA, 100 bp, Leptinotarsa decemlineata
atgttgaatcaggctcgattgaaagtattgaaggttagggaagatcacgttcgtaccgtactagaggaggcgcgtaaacgacttggtcaggtcacaaacg

SEQ ID NO: 204 - DNA, 43 bp, Artificial Sequence
  synthetic oligo
gcgtaatacgactcactataggatgttgaatcaggctcgattg

SEQ ID NO: 205 - DNA, 21 bp, Artificial Sequence
  synthetic oligo
cgtttgtgacctgaccaagtc

SEQ ID NO: 206 - DNA, 21 bp, Artificial Sequence
  synthetic oligo
atgttgaatcaggctcgattg

SEQ ID NO: 207 - DNA, 43 bp, Artificial Sequence
  synthetic oligo
gcgtaatacgactcactataggcgtttgtgacctgaccaagtc

SEQ ID NO: 208 - DNA, 60 bp, Leptinotarsa decemlineata
aagatcacgttcgtaccgtactagaggaggcgcgtaaacgacttggtcaggtcacaaacg

SEQ ID NO: 209 - DNA, 43 bp, Artificial Sequence
  synthetic oligo
gcgtaatacgactcactataggaagatcacgttcgtaccgtac

SEQ ID NO: 210 - DNA, 19 bp, Artificial Sequence
  synthetic oligo
cgtttgtgacctgaccaag

SEQ ID NO: 211 - DNA, 21 bp, Artificial Sequence
  synthetic oligo
aagatcacgttcgtaccgtac

SEQ ID NO: 212 - DNA, 41 bp, Artificial Sequence
  synthetic oligo
gcgtaatacgactcactataggcgtttgtgacctgaccaag

SEQ ID NO: 213 - DNA, 302 bp, Leptinotarsa decemlineata
aatgttgaatcaggctcgattgaaagtattgaaggttagggaagatcacgttcgtaccgtactagaggaggcgcgtaaacgacttggtcaggtcacaaacgatgttgaatcaggctcgattgaaagtattgaaggttagggaagatcacgttcgtaccgtactagaggaggcgcgtaaacgacttggtcaggtcacaaacgatgttgaatcaggctcgattgaaagtattgaaggttagggaagatcacgttcgtaccgtactagaggaggcgcgtaaacgacttggtcaggtcacaaacgc

SEQ ID NO: 214 - DNA, 302 bp, Leptinotarsa decemlineata
aaagatcacgttcgtaccgtactagaggaggcgcgtaaacgacttggtcaggtcacaaacgaagatcacgttcgtaccgtactagaggaggcgcgtaaacgacttggtcaggtcacaaacgaagatcacgttcgtaccgtactagaggaggcgcgtaaacgacttggtcaggtcacaaacgaagatcacgttcgtaccgtactagaggaggcgcgtaaacgacttggtcaggtcacaaacgaagatcacgttcgtaccgtactagaggaggcgcgtaaacgacttggtcaggtcacaaacgc

SEQ ID NO: 215 - DNA, 203 bp, Leptinotarsa decemlineata
cgccggagagtttttgtcagcttcttcaaaagctttgcgcaagttactctcagactcgccagcgagtttgctcatgatctccggcccgtttatcaagaagaagaacgccccagtctcattagccacggcgcgagcaatcagggtcttacccgtaccagggggaccatacagcagtatacccctagggggcttcacgccgatag

SEQ ID NO: 216 - DNA, 43 bp, Artificial Sequence
  synthetic oligo
gcgtaatacgactcactataggcgccggagagtttttgtcagc

SEQ ID NO: 217 - DNA, 19 bp, Artificial Sequence
  synthetic oligo
ctatcggcgtgaagccccc

SEQ ID NO: 218 - DNA, 21 bp, Artificial Sequence
  synthetic oligo
cgccggagagtttttgtcagc

SEQ ID NO: 219 - DNA, 41 bp, Artificial Sequence
  synthetic oligo
gcgtaatacgactcactataggctatcggcgtgaagccccc

SEQ ID NO: 220 - DNA, 903 bp, Leptinotarsa decemlineata
ggcatagtcaatataggaatctgggtgatggatccgttacgtccttcaacacggccggcacgttcatagatggtagctaaatcggtgtacatgtaacctgggaaaccacgacgaccaggcacctcttctctggcagcagatacctcacgcaaagcttctgcatacgaagacatatctgtcaagatgaccaagacgtgcttctcacattggtaagccaagaattcggcagctgtcaaagccagacgaggtgtaataattctttcaatggtaggatcgttggccaaattcaagaacaggcagacattctccatagaaccgttctcttcgaaatcctgtttgaagaacctagctgtttccatgttaacacccatagcagcgaaaacaatagcaaagttatcttcatgatcatcaagtacagatttaccaggaatcttgactaaaccagcctgtctacagatctgggcagcaatttcattgtgaggcagaccagctgcagagaaaatggggatcttctgaccacgagcaatggagttcatcacgtcaatagctgtaatacccgtctggatcatttcctcaggatagatacgggaccacggattgattggttgaccctggatgtccaagaagtcttcagccaaaattgggggacctttgtcgatgggttttcctgatccattgaaaacacgtcccaacatatcttcagaaacaggagtcctcaaaatatctcctgtgaattcacaagcggtgtttttggcgtcgattcctgatgtgccctcgaacacttgaaccacagcttttgacccactgacttccagaacttgtcccgaacgtatagtgccatcagccagtttgagttgtacgatttcattgtacttggggaacttaacatcttcgaggattacc

SEQ ID NO: 221 - DNA, 49 bp, Artificial Sequence
  synthetic oligo
gcgtaatacgactcactataggggcatagtcaatataggaatctgggtg

SEQ ID NO: 222 - DNA, 26 bp, Artificial Sequence
  synthetic oligo
ggtaatcctcgaagatgttaagttcc

SEQ ID NO: 223 - DNA, 27 bp, Artificial Sequence
  synthetic oligo
ggcatagtcaatataggaatctgggtg

SEQ ID NO: 224 - DNA, 48 bp, Artificial Sequence
  synthetic oligo
gcgtaatacgactcactataggggtaatcctcgaagatgttaagttcc

SEQ ID NO: 225 - DNA, 708 bp, Leptinotarsa decemlineata
ggagtcgcagaaatacgagagcaccttctcgaacaaccaagcctccttgagggtaaaacaagcccagtctgaggactcgggacactacactttgttggcggagaaccctcaaggctgcatagtgtcatctgcttacttagccatagaaccggtaaccacccaggaagggttgatccacgagtccaccttcaagcagcaacagaccgaaatggagcaaatcgacaccagcaagaccttggcgcctaacttcgtcagggtttgcggggatagagacgtgaccgagggcaagatgacccgcttcgactgtcgcgtcactggtcgtccttatccagacgtgacatggtacataaacggtcgacaagtcaccgacgaccacaaccacaagattttggttaacgaatccggaaaccatgccctgatgatcaccaccgtgagcaggaacgactcaggagtagtgacctgcgtcgccaggaacaagacgggagaaacctccttccagtgcaaccttaacgtcatcgaaaaggaacaggtagtcgcgcccaagttcgtggagagatttaccacagtcaacgtggcagaaggagaaccagtgtctctgcgcgctagagctgttggcacgccggtgccgcgaatcacttggcagagggacggggcgcccctagccagcgggcccgacgttcgcatcgcgattgacggtggagcctctac

SEQ ID NO: 226 - DNA, 46 bp, Artificial Sequence
  synthetic oligo
gcgtaatacgactcactataggggagtcgcagaaatacgagagcac

SEQ ID NO: 227 - DNA, 23 bp, Artificial Sequence
  synthetic oligo
gtagaggctccaccgtcaatcgc

SEQ ID NO: 228 - DNA, 24 bp, Artificial Sequence
  synthetic oligo
ggagtcgcagaaatacgagagcac

SEQ ID NO: 229 - DNA, 45 bp, Artificial Sequence
  synthetic oligo
gcgtaatacgactcactatagggtagaggctccaccgtcaatcgc

SEQ ID NO: 230 - DNA, 967 bp, Leptinotarsa decemlineata
gggagcagacgatcggttggttaaaatctgggactatcaaaacaaaacgtgtgtccaaaccttggaaggacacgcccaaaacgtaaccgcggtttgtttccaccctgaactacctgtggctctcacaggcagcgaagatggtaccgttagagtttggcatacgaatacacacagattagagaattgtttgaattatgggttcgagagagtgtggaccatttgttgcttgaagggttcgaataatgtttctctggggtatgacgagggcagtatattagtgaaagttggaagagaagaaccggcagttagtatggatgccagtggcggtaaaataatttgggcaaggcactcggaattacaacaagctaatttgaaggcgctgccagaaggtggagaaataagagatggggagcgtttacctgtctctgtaaaagatatgggagcatgtgaaatataccctcaaacaatccaacataatccgaatggaagattcgttgtagtatgcggagacggcgaatatatcatttacacagcgatggctctacggaacaaggcttttggaagcgctcaagagtttgtctgggctcaggactccagcgagtatgccattcgcgagtctggttccacaattcggatattcaaaaacttcaaagaaaggaagaacttcaagtcggatttcagcgcggaaggaatctacgggggttttctcttggggattaaatcggtgtccggtttaacgttttacgattgggaaactttggacttggtgagacggattgaaatacaaccgagggcggtttattggtctgacagtggaaaattagtctgtctcgcaacggaggacagctacttcatcctttcttatgattcggagcaagttcagaaggccagggagaacaatcaagtcgcagaggatggcgtagaggccgctttcgatgtgttgggggaaatgaacgagtctgtccga

SEQ ID NO: 231 - DNA, 42 bp, Artificial Sequence
  synthetic oligo
gcgtaatacgactcactatagggggagcagacgatcggttgg

SEQ ID NO: 232 - DNA, 23 bp, Artificial Sequence
  synthetic oligo
tcggacagactcgttcatttccc

SEQ ID NO: 233 - DNA, 20 bp, Artificial Sequence
  synthetic oligo
gggagcagacgatcggttgg

SEQ ID NO: 234 - DNA, 45 bp, Artificial Sequence
  synthetic oligo
gcgtaatacgactcactataggtcggacagactcgttcatttccc

SEQ ID NO: 235 - DNA, 258 bp, Leptinotarsa decemlineata
agatacccagatcatatgaaacggcatgactttttcaagagtgccatgcccgaaggttatgtacaggaaagaactatatttttcaaagatgacgggaactacaagacacgtaagtttaaacagttcggtactaactaaccatacatatttaaattttcaggtgctgaagtcaagtttgaaggtgatacccttgttaatagaatcgagttaaaaggtattgattttaaagaagatggaaacattcttggacacaaattg

SEQ ID NO: 236 - DNA, 46 bp, Artificial Sequence
  synthetic oligo
gcgtaatacgactcactataggagatacccagatcatatgaaacgg

SEQ ID NO: 237 - DNA, 24 bp, Artificial Sequence
  synthetic oligo
caatttgtgtccaagaatgtttcc

SEQ ID NO: 238 - DNA, 24 bp, Artificial Sequence
  synthetic oligo
agatacccagatcatatgaaacgg

SEQ ID NO: 239 - DNA, 46 bp, Artificial Sequence
  synthetic oligo
gcgtaatacgactcactataggcaatttgtgtccaagaatgtttcc

SEQ ID NO: 240 - DNA, 1961 bp, Leptinotarsa decemlineata
gcccttgcaatgtcatccatcatgtcgtgtacattgtccacgtccaagtttttatgggctttcttaagagcttcagctgcatttttcatagattccaatactgtggtgttcgtactagctccctccagagcttctcgttgaagttcaatagtagttaaagtgccatctatttgcaactgatttttttctaatcgcttcttccgcttcagcgcttgcatggccgctcaagggcgaattcaccagctttcttgtacaaagtggtatatcactagtgcggccgcctgcaggtcgaccatatggtcgacctgcaggcggccgcactagtgatgctgttatgttcagtgtcaagctgacctgcaaacacgttaaatgctaagaagttagaatatatgagacacgttaactggtatatgaataagctgtaaataaccgagtataaactcattaactaatatcacctctagagtataatataatcaaattcgacaatttgactttcaagagtaggctaatgtaaaatctttatatatttctacaatgttcaaagaaacagttgcatctaaacccctatggccatcaaattcaatgaacgctaagctgatccggcgagattttcaggagctaaggaagctaaaatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaattccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcaccatgggcaaatattatacgcaaggcgacaaggtgctgatgccgctggcgattcaggttcatcatgccgtctgtgatggcttccatgtcggcagaatgcttaatgaattacaacagtactgcgatgagtggcagggcggggcgtaaacgcgtggatcagcttaatatgactctcaataaagtctcataccaacaagtgccaccttattcaaccatcaagaaaaaagccaaaatttatgctactctaaggaaaacttcactaaagaagacgatttagagtgttttaccaagaatttctgtcatcttactaaacaactaaagatcggtgtgatacaaaacctaatctcattaaagtttatgctaaaataagcataattttacccactaagcgtgaccagataaacataactcagcacaccagagcatatatattggtggctcaaatcatagaaacttacagtgaagacacagaaagccgtaagaagaggcaagagtatgaaaccttacctcatcatttccatgaggttgcttctgatcccgcgggatatcaccactttgtacaagaaagctgggtcgaattcgcccttgagcggccatgcaagcgctgaagcggaagaagcgattagaaaaaaatcagttgcaaatagatggcactttaactactattgaacttcaacgagaagctctggagggagctagtacgaacaccacagtattggaatctatgaaaaatgcagctgaagctcttaagaaagcccataaaaacttggacgtggacaatgtacacgacatgatggatgacattgcaagggc

SEQ ID NO: 241 - DNA, 2640 bp, Leptinotarsa decemlineata
gcccttggagcgagactacaacaactatggctggcaggtgttggttgcttctggtgtggtggaatacatcgacactcttgaagaagaaactgtcatgattgcgatgaatcctgaggatcttcggcaggacaaagaatatgcttattgtacgacctacacccactgcgaaatccacccggccatgatcttgggcgtttgcgcgtctattatacctttccccgatcataaccagagcccaaggaacacctaccagagcgctatgggtaagcaagctatgggggtctacattacgaatttccacgtgcggatggacaccctggcccacgtgctatactacccgcacaaacctctggtcactaccaggtctatggagtatctgcggttcagagaattaccagccgggatcaacagtatagttgctattgcttgttatactggttataatcaagaagattctgttattctgaacgcgtctgctgtggaaagaggatttttccgatccgtgttttatcgttcctataaagatgccgaatcgaagcgaattggcgatcaagaagagcagttcgagaagggcgaattcaccagctttcttgtacaaagtggtatatcactagtgcggccgcctgcaggtcgaccatatggtcgacctgcaggcggccgcactagtgatgctgttatgttcagtgtcaagctgacctgcaaacacgttaaatgctaagaagttagaatatatgagacacgttaactggtatatgaataagctgtaaataaccgagtataaactcattaactaatatcacctctagagtataatataatcaaattcgacaatttgactttcaagagtaggctaatgtaaaatctttatatatttctacaatgttcaaagaaacagttgcatctaaacccctatggccatcaaattcaatgaacgctaagctgatccggcgagattttcaggagctaaggaagctaaaatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaattccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcaccatgggcaaatattatacgcaaggcgacaaggtgctgatgccgctggcgattcaggttcatcatgccgtctgtgatggcttccatgtcggcagaatgcttaatgaattacaacagtactgcgatgagtggcagggcggggcgtaaacgcgtggatcagcttaatatgactctcaataaagtctcataccaacaagtgccaccttattcaaccatcaagaaaaaagccaaaatttatgctactctaaggaaaacttcactaaagaagacgatttagagtgttttaccaagaatttctgtcatcttactaaacaactaaagatcggtgtgatacaaaacctaatctcattaaagtttatgctaaaataagcataattttacccactaagcgtgaccagataaacataactcagcacaccagagcatatatattggtggctcaaatcatagaaacttacagtgaagacacagaaagccgtaagaagaggcaagagtatgaaaccttacctcatcatttccatgaggttgcttctgatcccgcgggatatcaccactttgtacaagaaagctgggtcggcccttctcgaactgctcttcttgatcgccaattcgcttcgattcggcatctttataggaacgataaaacacggatcggaaaaatcctctttccacagcagacgcgttcagaataacagaatcttcttgattataaccagtataacaagcaatagcaactatactgttgatcccggctggtaattctctgaaccgcagatactccatagacctggtagtgaccagaggtttgtgcgggtagtatagcacgtgggccagggtgtccatccgcacgtggaaattcgtaatgtagacccccatagcttgcttacccatagcgctctggtaggtgttccttgggctctggttatgatcggggaaaggtataatagacgcgcaaacgcccaagatcatggccgggtggatttcgcagtgggtgtaggtcgtacaataagcatattctttgtcctgccgaagatcctcaggattcatcgcaatcatgacagtttcttcttcaagagtgtcgatgtattccaccacaccagaagcaaccaacacctgccagccatagttgttgtagtctcgctccaagggc

SEQ ID NO: 242 - DNA, 3584 bp, Leptinotarsa decemlineata
gcccttccgaagaaggatgtgaagggtacttacgtatccatacacagttcaggcttcagagattttttattgaaaccagaaattctaagagctatagttgactgcggttttgaacacccttcagaagttcagcacgaatgtattcctcaagctgtcattggcatggacattttatgtcaagccaaatctggtatgggcaaaacggcagtgtttgttctggcgacactgcaacaattggaaccagcggacaatgttgtttacgttttggtgatgtgtcacactcgtgaactggctttccaaatcagcaaagagtacgagaggttcagtaaatatatgcccagtgtcaaggtgggcgtctttttcggaggaatgcctattgctaacgatgaagaagtattgaaaaacaaatgtccacacattgttgtggggacgcctgggcgtattttggcgcttgtcaagtctaggaagctagtcctcaagaacctgaaacacttcattcttgatgagtgcgataaaatgttagaactgttggatatgaggagagacgtccaggaaatctacagaaacacccctcacaccaagcaagtgatgatgttcagtgccacactcagcaaagaaatcaggccggtgtgcaagaaattcatgcaagatccaatggaggtgtatgtagacgatgaagccaaattgacgttgcacggattacaacagcattacgttaaactcaaagaaaatgaaaagaataaaaaattatttgagttgctcgatgttctcgaatttaatcaggtggtcatttttgtgaagtccgttcaaaggtgtgtggctttggcacagttgctgactgaacagaatttcccagccataggaattcacagaggaatggaccagaaagagaggttgtctcggtatgagcagttcaaagatttccagaagagaatattggtagctacgaatctctttgggcgtggcatggacattgaaagggtcaacattgtcttcaactatgatatgccagaggactccgacacctacttgcatcgaagggcgaattcaccagctttcttgtacaaagtggtatatcactagtgcggccgcctgcaggtcgaccatatggtcgacctgcaggcggccgcactagtgatgctgttatgttcagtgtcaagctgacctgcaaacacgttaaatgctaagaagttagaatatatgagacacgttaactggtatatgaataagctgtaaataaccgagtataaactcattaactaatatcacctctagagtataatataatcaaattcgacaatttgactttcaagagtaggctaatgtaaaatctttatatatttctacaatgttcaaagaaacagttgcatctaaacccctatggccatcaaattcaatgaacgctaagctgatccggcgagattttcaggagctaaggaagctaaaatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaattccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcaccatgggcaaatattatacgcaaggcgacaaggtgctgatgccgctggcgattcaggttcatcatgccgtctgtgatggcttccatgtcggcagaatgcttaatgaattacaacagtactgcgatgagtggcagggcggggcgtaaacgcgtggatcagcttaatatgactctcaataaagtctcataccaacaagtgccaccttattcaaccatcaagaaaaaagccaaaatttatgctactctaaggaaaacttcactaaagaagacgatttagagtgttttaccaagaatttctgtcatcttactaaacaactaaagatcggtgtgatacaaaacctaatctcattaaagtttatgctaaaataagcataattttacccactaagcgtgaccagataaacataactcagcacaccagagcatatatattggtggctcaaatcatagaaacttacagtgaagacacagaaagccgtaagaagaggcaagagtatgaaaccttacctcatcatttccatgaggttgcttctgatcccgcgggatatcgaccactttgtacaagaaagctgggtcgaattcgcccttcgatgcaagtaggtgtcggagtcctctggcatatcatagttgaagacaatgttgaccctttcaatgtccatgccacgcccaaagagattcgtagctaccaatattctcttctggaaatctttgaactgctcataccgagacaacctctctttctggtccattcctctgtgaattcctatggctgggaaattctgttcagtcagcaactgtgccaaagccacacacctttgaacggacttcacaaaaatgaccacctgattaaattcgagaacatcgagcaactcaaataattttttattcttttcattttctttgagtttaacgtaatgctgttgtaatccgtgcaacgtcaatttggcttcatcgtctacatacacctccattggatcttgcatgaatttcttgcacaccggcctgatttctttgctgagtgtggcactgaacatcatcacttgcttggtgtgaggggtgtttctgtagatttcctggacgtctctcctcatatccaacagttctaacattttatcgcactcatcaagaatgaagtgtttcaggttcttgaggactagcttcctagacttgacaagcgccaaaatacgcccaggcgtccccacaacaatgtgtggacatttgtttttcaatacttcttcatcgttagcaataggcattcctccgaaaaagacgcccaccttgacactgggcatatatttactgaacctctcgtactctttgctgatttggaaagccagttcacgagtgtgacacatcaccaaaacgtaaacaacattgtccgctggttccaattgttgcagtgtcgccagaacaaacactgccgttttgcccataccagatttggcttgacataaaatgtccatgccaatgacagcttgaggaatacattcgtgctgaacttctgaagggtgttcaaaaccgcagtcaactatagctcttagaatttctggtttcaataaaaaatctctgaagcctgaactgtgtatggatacgtaagtacccttcacatccttcttcggaagggc

SEQ ID NO: 243 - DNA, 4723 bp, Leptinotarsa decemlineata
gcccttcgccattgggcgatggtttcgccatggaatatcagaatctggaagaacgtgtccatgagcagaattctatcgggttggatggaactcgtatccaaaagcacaggttctggtggtccattgaaactgtagctgtagagtatcggctggatcatgatcagcgactgcgtgaggtcttcgcgcataagcatgtgcctgtagaaggacgtttcgtcgggagaattgttaaacacctgcaggaactgtgaccttctcaaatggtacatgaactgcgggtagaggctgaagttttcgcccaagcggaacgaattcgggtcgtccttgttatattcgccgaatttctggcacagacgtatcaacatcctatcgacccatctcaaaacatcagggctatcgtctgattccgctctgtaaactgccatcctcgccattatcactgcggctgcctcctgatcgaatccagcactgacatgatgtatattagcggaagcatcggcccagtttctagcaactgtcgttactcggatcctcttctggccactagcatgctgatattgcgtgatgaactgtatgcagccccttcccccttgaggtatgggagcggaatgttggttgacgacctcgaagaacaaggccatggtagtacttggagttaccgtacacattttccactggaccgtgttacccattcctatttcggtgtcggaaaccaaaggattcttcacattcaacgaaacacaagatccaataccgccttgaattttcaactccctggaacacttgaccctccagagtaccattaaatgccatcttcagctcgtttttctgatctttcgaaaatatgcgctggaacgtttgcttgaacagggaagaattgaacgagtcgcccatgaccatatgtccccctgttgaattacaacactgtttcatctccatcaatcctgtctgatccaaagcgcatgaatatatgtcaacgcagtggccattcgttgctgctctcatcgctaaattatcatagtgcttgattgctttcttcatgtatttggcattgtctttttggatgtcgtggtgagatctgataggttgcttcagatcatcattcaagacttgaccagggccttgagagcaaggtcctccaacgaatagcatgaccctggcaccagtattggcgtatgtgcactccaacaacccaatggctatcgataaagctgtcccggtcgatctaagggcgcatttgccttggtggacaggccatgggtctctttgcaactctccaataagatcagtgaggttcatgtcgcatttcgagatgggttgaaggaacctgcttcctggtggcgtaggagcttgctggagtgctccaggcctcatgggttgtcctggttgttgaggagcaggttgagcacttactgcggctctgcccacttccaacatctcttgaacttgcttagctgtgaggtctttcgtccctcggaaaacgtaagatttgctgcagccctcggtacctagttcgtgcacttggaccatcttcccaaaggtaatcaaccctatcaaggcattcgggggcaacaagctcaaagacatctgcaacgaatccttgagagaagggcgaattcaccagctttcttgtacaaagtggtatatcactagtgcggccgcctgcaggtcgaccatatggtcgacctgcaggcggccgcactagtgatgctgttatgttcagtgtcaagctgacctgcaaacacgttaaatgctaagaagttagaatatatgagacacgttaactggtatatgaataagctgtaaataaccgagtataaactcattaactaatatcacctctagagtataatataatcaaattcgacaatttgactttcaagagtaggctaatgtaaaatctttatatatttctacaatgttcaaagaaacagttgcatctaaacccctatggccatcaaattcaatgaacgctaagctgatccggcgagattttcaggagctaaggaagctaaaatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaattccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcaccatgggcaaatattatacgcaaggcgacaaggtgctgatgccgctggcgattcaggttcatcatgccgtctgtgatggcttccatgtcggcagaatgcttaatgaattacaacagtactgcgatgagtggcagggcggggcgtaaacgcgtggatcagcttaatatgactctcaataaagtctcataccaacaagtgccaccttattcaaccatcaagaaaaaagccaaaatttatgctactctaaggaaaacttcactaaagaagacgatttagagtgttttaccaagaatttctgtcatcttactaaacaactaaagatcggtgtgatacaaaacctaatctcattaaagtttatgctaaaataagcataattttacccactaagcgtgaccagataaacataactcagcacaccagagcatatatattggtggctcaaatcatagaaacttacagtgaagacacagaaagccgtaagaagaggcaagagtatgaaaccttacctcatcatttccatgaggttgcttctgatcccgcgggatatcgaccactttgtacaagaaagctggtcgaattcgcccttctctcaaggattcgttgcagatgtctttgagcttgttgcccccgaatgccttgatagggttgattacctttgggaagatggtccaagtgcacgaactaggtaccgagggctgcagcaaatcttacgttttccgagggacgaaagacctcacagctaagcaagttcaagagatgttggaagtgggcagagccgcagtaagtgctcaacctgctcctcaacaaccaggacaacccatgaggcctggagcactccagcaagctcctacgccaccaggaagcaggttccttcaacccatctcgaaatgcgacatgaacctcactgatcttattggagagttgcaaagagacccatggcctgtccaccaaggcaaatgcgcccttagatcgaccgggacagctttatcgatagccattgggttgttggagtgcacatacgccaatactggtgccagggtcatgctattcgttggaggaccttgctctcaaggccctggtcaagtcttgaatgatgatctgaagcaacctatcagatctcaccacgacatccaaaaagacaatgccaaatacatgaagaaagcaatcaagcactatgataatttagcgatgagagcagcaacgaatggccactgcgttgacatatattcatgcgctttggatcagacaggattgatggagatgaaacagtgttgtaattcaacagggggacatatggtcatgggcgactcgttcaattcttccctgttcaagcaaacgttccagcgcatattttcgaaagatcagaaaaacgagctgaagatggcatttaatggtactctggagggtcaagtgttccagggagttgaaaattcaaggcggtattggatcttgtgtttcgttgaatgtgaagaatcctttggtttccgacaccgaaataggaatgggtaacacggtccagtggaaaatgtgtacggtaactccaagtactaccatggccttgttcttcgaggtcgtcaaccaacattccgctcccatacctcaagggggaaggggctgcatacagttcatcacgcaatatcagcatgctagtggccagaagaggatccgagtaacgacagttgctagaaactgggccgatgcttccgctaatatacatcatgtcagtgctggattcgatcaggaggcagccgcagtgataatggcgaggatggcagtttacagagcggaatcagacgatagccctgatgttttgagatgggtcgataggatgttgatacgtctgtgccagaaattcggcgaatataacaaggacgacccgaattcgttccgcttgggcgaaaacttcagcctctacccgcagttcatgtaccatttgagaaggtcacagttcctgcaggtgtttaacaattctcccgacgaaacgtccttctacaggcacatgcttatgcgcgaagacctcacgcagtcgctgatcatgatccagccgatactctacagctacagtttcaatggaccaccagaacctgtgcttttggatacgagttccatccaacccgatagaattctgctcatggacacgttcttccagattctgatattccatggcgaaaccatcgcccaatggcgaagggc

SEQ ID NO: 244 - DNA, 2584 bp, Leptinotarsa decemlineata
gcccttgtggaagcagggctggcatggcgacaaattctagattgggatcaccaataagcttcctagctagccataggaaaggcttctcaaagttgtagttagatttggcagagatatcatagtactgcaaattcttcttcctatgaaagacaatacttttcgcttttacttttctgtctttgatgtcaaccttgttcccgcaaagtactatcgggatattttcacagactctgacaagatctctgtgccaatttggtacattcttgtatgtaactctggaagttacatcaaacatgataatagcacactgtccctgaatgtaatatccatcacggagaccaccaaacttctcctgaccggcagtgtcccatacattgaaccgaatagggcccctgtttgtatggaagaccagaggatggacttcaactcccaaagtagctacatatcttttttcaaattcaccagtcatatgacgtttcacaaatgtcgtttttccagtacctccatctccgaccaacacacacttgaaagtgggaagggcgaattcgacccagctttcttgtacaaagtggtgatatcactagtgcggccgcctgcaggtcgaccatatggtcgacctgcaggcggccgcactagtgatgctgttatgttcagtgtcaagctgacctgcaaacacgttaaatgctaagaagttagaatatatgagacacgttaactggtatatgaataagctgtaaataaccgagtataaactcattaactaatatcacctctagagtataatataatcaaattcgacaatttgactttcaagagtaggctaatgtaaaatctttatatatttctacaatgttcaaagaaacagttgcatctaaacccctatggccatcaaattcaatgaacgctaagctgatccggcgagattttcaggagctaaggaagctaaaatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaattccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcaccatgggcaaatattatacgcaaggcgacaaggtgctgatgccgctggcgattcaggttcatcatgccgtctgtgatggcttccatgtcggcagaatgcttaatgaattacaacagtactgcgatgagtggcagggcggggcgtaaacgcgtggatcagcttaatatgactctcaataaagtctcataccaacaagtgccaccttattcaaccatcaagaaaaaagccaaaatttatgctactctaaggaaaacttcactaaagaagacgatttagagtgttttaccaagaatttctgtcatcttactaaacaactaaagatcggtgtgatacaaaacctaatctcattaaagtttatgctaaaataagcataattttacccactaagcgtgaccagataaacataactcagcacaccagagcatatatattggtggctcaaatcatagaaacttacagtgaagacacagaaagccgtaagaagaggcaagagtatgaaaccttacctcatcatttccatgaggttgcttctgatcccgcgggatatcggaccactttgtacaagaaagctgggtcgaattcgcccttcccactttcaagtgtgtgttggtcggagatggaggtactggaaaaacgacatttgtgaaacgtcatatgactggtgaatttgaaaaaagatatgtagctactttgggagttgaagtccatcctctggtcttccatacaaacaggggccctattcggttcaatgtatgggacactgccggtcaggagaagtttggtggtctccgtgatggatattacattcagggacagtgtgctattatcatgtttgatgtaacttccagagttacatacaagaatgtaccaaattggcacagagatcttgtcagagtctgtgaaaatatcccgatagtactttgcgggaacaaggttgacatcaaagacagaaaagtaaaagcgaaaagtattgtctttcataggaagaagaatttgcagtactatgatatctctgccaaatctaactacaactttgagaagcctttcctatggctagctaggaagcttattggtgatcccaatctagaatttgtcgccatgccagccctgcttccacaagggc

SEQ ID NO: 245 - DNA, 2736 bp, Leptinotarsa decemlineata
gcccttcgcagatcaagcatatgatggctttcattgaacaagaggcaaacgaaaaggcagaagaaatcgatgccaaggccgaggaagaatttaatattgaaaaggggcgccttgttcagcaacaacgtctcaagattatggaatattatgagaagaaagagaaacaggtcgaactccagaaaaaaatccaatcgtctaacatgttgaatcaggctcgattgaaagtattgaaggttagggaagatcacgttcgtaccgtactagaggaggcgcgtaaacgacttggtcaggtcacaaacgaccagggaaaatattcccaaatcctggaaagcctcattttgcagggattatatcagctttttgagaaagatgttaccattcgagttcggccccaggaccgagaactggtcaaatccatcattcccaccgtcacgaacaagtataaagatgccaccggtaaggacatccatctgaaaattgatgacgaaatccatctgtcccaagaaaccaccgggggaatcgacctgctggcgcagaaaaacaaaatcaagatcagcaatactatggaggctcgtctggagctgatttcgcagcaacttctgcccgagatccgaagggcgaattcaccagctttcttgtacaaagtggtatatcactagtgcggccgcctgcaggtcgaccatatggtcgacctgcaggcggccgcactagtgatgctgttatgttcagtgtcaagctgacctgcaaacacgttaaatgctaagaagttagaatatatgagacacgttaactggtatatgaataagctgtaaataaccgagtataaactcattaactaatatcacctctagagtataatataatcaaattcgacaatttgactttcaagagtaggctaatgtaaaatctttatatatttctacaatgttcaaagaaacagttgcatctaaacccctatggccatcaaattcaatgaacgctaagctgatccggcgagattttcaggagctaaggaagctaaaatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaattccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcaccatgggcaaatattatacgcaaggcgacaaggtgctgatgccgctggcgattcaggttcatcatgccgtctgtgatggcttccatgtcggcagaatgcttaatgaattacaacagtactgcgatgagtggcagggcggggcgtaaacgcgtggatcagcttaatatgactctcaataaagtctcataccaacaagtgccaccttattcaaccatcaagaaaaaagccaaaatttatgctactctaaggaaaacttcactaaagaagacgatttagagtgttttaccaagaatttctgtcatcttactaaacaactaaagatcggtgtgatacaaaacctaatctcattaaagtttatgctaaaataagcataattttacccactaagcgtgaccagataaacataactcagcacaccagagcatatatattggtggctcaaatcatagaaacttacagtgaagacacagaaagccgtaagaagaggcaagagtatgaaaccttacctcatcatttccatgaggttgcttctgatcccgcgggatatcgaccactttgtacaagaaagctgggtcgaattcgcccttcggatctcgggcagaagttgctgcgaaatcagctccagacgagcctccatagtattgctgatcttgattttgtttttctgcgccagcaggtcgattcccccggtggtttcttgggacagatggatttcgtcatcaattttcagatggatgtccttaccggtggcatctttatacttgttcgtgacggtgggaatgatggatttgaccagttctcggtcctggggccgaactcgaatggtaacatctttctcaaaaagctgatataatccctgcaaaatgaggctttccaggatttgggaatattttccctggtcgtttgtgacctgaccaagtcgtttacgcgcctcctctagtacggtacgaacgtgatcttccctaaccttcaatactttcaatcgagcctgattcaacatgttagacgattggatttttttctggagttcgacctgtttctctttcttctcataatattccataatcttgagacgttgttgctgaacaaggcgccccttttcaatattaaattcttcctcggccttggcatcgatttcttctgccttttcgtttgcctcttgttcaatgaaagccatcatatgcttgatctgcgaagggc

SEQ ID NO: 246 - DNA, 3435 bp, Leptinotarsa decemlineata
gcccttggaataggatgggtaatgtcgtcgttgggcatagtcaatataggaatctgggtgatggatccgttacgtccttcaacacggccggcacgttcatagatggtagctaaatcggtgtacatgtaacctgggaaaccacgacgaccaggcacctcttctctggcagcagatacctcacgcaaagcttctgcatacgaagacatatctgtcaagatgaccaagacgtgcttctcacattggtaagccaagaattcggcagctgtcaaagccagacgaggtgtaataattctttcaatggtaggatcgttggccaaattcaagaacaggcagacattctccatagaaccgttctcttcgaaatcctgtttgaagaacctagctgtttccatgttaacacccatagcagcgaaaacaatagcaaagttatcttcatgatcatcaagtacagatttaccaggaatcttgactaaaccagcctgtctacagatctgggcagcaatttcattgtgaggcagaccagctgcagagaaaatggggatcttctgaccacgagcaatggagttcatcacgtcaatagctgtaatacccgtctggatcatttcctcaggatagatacgggaccacggattgattggttgaccctggatgtccaagaagtcttcagccaaaattgggggacctttgtcgatgggttttcctgatccattgaaaacacgtcccaacatatcttcagaaacaggagtcctcaaaatatctcctgtgaattcacaagcggtgtttttggcgtcgattcctgatgtgccctcgaacacttgaaccacagcttttgacccactgacttccagaacttgtcccgaacgtatagtgccatcagccagtttgagttgtacgatttcattgtacttggggaacttaacatcttcgaggattaccagaggaccgttcacaccagacacagtcaagggcgaattcaccagctttcttgtacaaagtggtatatcactagtgcggccgcctgcaggtcgaccatatggtcgacctgcaggcggccgcactagtgatgctgttatgttcagtgtcaagctgacctgcaaacacgttaaatgctaagaagttagaatatatgagacacgttaactggtatatgaataagctgtaaataaccgagtataaactcattaactaatatcacctctagagtataatataatcaaattcgacaatttgactttcaagagtaggctaatgtaaaatctttatatatttctacaatgttcaaagaaacagttgcatctaaacccctatggccatcaaattcaatgaacgctaagctgatccggcgagattttcaggagctaaggaagctaaaatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaattccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcaccatgggcaaatattatacgcaaggcgacaaggtgctgatgccgctggcgattcaggttcatcatgccgtctgtgatggcttccatgtcggcagaatgcttaatgaattacaacagtactgcgatgagtggcagggcggggcgtaaacgcgtggatcagcttaatatgactctcaataaagtctcataccaacaagtgccaccttattcaaccatcaagaaaaaagccaaaatttatgctactctaaggaaaacttcactaaagaagacgatttagagtgttttaccaagaatttctgtcatcttactaaacaactaaagatcggtgtgatacaaaacctaatctcattaaagtttatgctaaaataagcataattttacccactaagcgtgaccagataaacataactcagcacaccagagcatatatattggtggctcaaatcatagaaacttacagtgaagacacagaaagccgtaagaagaggcaagagtatgaaaccttacctcatcatttccatgaggttgcttctgatcccgcgggatatcaccactttgtacaagaaagctgggtcgaattcgcccttgactgtgtctggtgtgaacggtcctctggtaatcctcgaagatgttaagttccccaagtacaatgaaatcgtacaactcaaactggctgatggcactatacgttcgggacaagttctggaagtcagtgggtcaaaagctgtggttcaagtgttcgagggcacatcaggaatcgacgccaaaaacaccgcttgtgaattcacaggagatattttgaggactcctgtttctgaagatatgttgggacgtgttttcaatggatcaggaaaacccatcgacaaaggtcccccaattttggctgaagacttcttggacatccagggtcaaccaatcaatccgtggtcccgtatctatcctgaggaaatgatccagacgggtattacagctattgacgtgatgaactccattgctcgtggtcagaagatccccattttctctgcagctggtctgcctcacaatgaaattgctgcccagatctgtagacaggctggtttagtcaagattcctggtaaatctgtacttgatgatcatgaagataactttgctattgttttcgctgctatgggtgttaacatggaaacagctaggttcttcaaacaggatttcgaagagaacggttctatggagaatgtctgcctgttcttgaatttggccaacgatcctaccattgaaagaattattacacctcgtctggctttgacagctgccgaattcttggcttaccaatgtgagaagcacgtcttggtcatcttgacagatatgtcttcgtatgcagaagctttgcgtgaggtatctgctgccagagaagaggtgcctggtcgtcgtggtttcccaggttacatgtacaccgatttagctaccatctatgaacgtgccggccgtgttgaaggacgtaacggatccatcacccagattcctatattgactatgcccaacgacgacattacccatcctattccaagggc

SEQ ID NO: 247 - DNA, 537 bp, Phaedon cochleariae
catttgaagcgtttagctgctcccaaagcatggatgttggacaaattggggggtgtcttcgcccctcgtccatccaccgggcctcacaagttgcgcgaatccctgcctttagtgattttccttcgtaacaggctgaagtatgcccttacaaacagtgaagtcactaaaattgtcatgcaaaggttgatcaaagttgatggtaaagtgaggactgattctaattaccctgctggtttcatggatgtcattactattgagaagactggtgaatttttccgtctgatctatgatgttaaaggaagatttgctgtgcaccgtattacagctgaagaggcaaaatacaagttgtgtaaagtaaggagagtccaaactggtcccaaaggaatcccatttttggtaacacatgatggcagaaccattcgttaccctgaccccaacatcaaagtgaatgacacaattcaaatggaaattgctacatctaaaattcttgactacatcaaatttgaatctggcaacctctgcatgatcacggggagg

SEQ ID NO: 248 - protein, 161 aa, Phaedon cochleariae
AWMLDKLGGVFAPRPSTGPHKLRESLPLVIFLRNRLKYALTNSEVTKIVMQRLIKVDGKVRTDSNYPAGFMDVITIEKTGEFFRLIYDVKGRFAVHRITAEEAKYKLCKVRRVQTGPKGIPFLVTHDGRTIRYPDPNIKVNDTIQMEIATSKILDYIKFES

SEQ ID NO: 249 - DNA, 477 bp, Phaedon cochleariae
ccctagacgtccctatgaaaaggcccgtctggatcaggaattgaaaattatcggcgcctttggtttacgaaacaaacgtgaagtgtggagagtaaagtacactttggctaaaatccgtaaagctgctcgtgaactgctcaccctagaagaaaaagagcctaaaagattgtttgaaggtaatgcacttctacgtcgtttggtgcgaattggtgttctggatgagaacaggatgaagcttgattatgttttgggtctgaaaattgaagatttcttggaaagaaggctccaaactcaggtgttcaaatctggtctggcaaagtcaattcatcatgctagagtactgattaggcagagacacatccgggtgcgcaagcaggtggtgaacatcccctcgttcatcgtgcggctggactcgcagaagcacatcgacttctccctgaagtcgcccttcgggggtggccgacctggccgtgtcaa

SEQ ID NO: 250 - protein, 158 aa, Phaedon cochleariae
PRRPYEKARLDQELKIIGAFGLRNKREVWRVKYTLAKIRKAARELLTLEEKEPKRLFEGNALLRRLVRIGVLDENRMKLDYVLGLKIEDFLERRLQTQVFKSGLAKSIHHARVLIRQRHIRVRKQVVNIPSFIVRLDSQKHIDFSLKSPFGGGRPGRV

SEQ ID NO: 251 - DNA, 504 bp, Phaedon cochleariae
tgcgatgcggcaaaaagaaggtgtggttggatccaaatgaaatcaacgaaatcgccaacaccaactcaagacaaaacatccgtaagctcatcaaggatggtcttatcatcaagaagccagtggcagtacactctagggcccgtgtacgcaagaacactgaagccagaaggaagggaaggcattgtggatttggaaagaggaagggtacggcaaatgcccgtatgcctcaaaaggaactgtgggtgcagcgcatgcgcgtcctcaggcgcctcctcaaaaagtacagggaggccaagaaaatcgaccgccatctttaccacgccctgtacatgaaagcgaagggtaacgtgttcaggaacaagagggtccttatggagtacatccacaagaagaaggcagagaaggccagggccaagatgctgtctgaccaggctaacgccaggagattgaaggtgaagcaggccagggaacgtagggaagagcgtatcgccaccaagaagcagg

SEQ ID NO: 252 - protein, 149 aa, Phaedon cochleariae
PNEINEIANTNSRQNIRKLIKDGLIIKKPVAVHSRARVRKNTEARRKGRHCGFGKRKGTANARMPQKELWVQRMRVLRRLLKKYREAKKIDRHLYHALYMKAKGNVFRNKRVLMEYIHKKKAEKARAKMLSDQANARRLKVKQARERRE

SEQ ID NO: 253 - DNA, 1594 bp, Phaedon cochleariae
ctctcaaggattctttgcagatgtcgctcagcctattaccgcccaacgcgttgattggattgatcacgttcggaaaaatggtgcaagtccacgaactgggtaccgaaggctgcagcaagtcgtacgtgttctgtggaacgaaagatctcaccgccaagcaagtccaggagatgttgggcattggaaaagggtcaccaaatccccaacaacagccagggcaacctgggcggccagggcagaatccccaagctgcccctgtaccaccggggagcagattcttgcagcccgtgtcaaaatgcgacatgaacttgacagatctgatcggggagttgcagaaagacccttggcccgtacatcagggcaaaagacctcttagatccacaggcgcagcattgtccatcgctgtcggcctcttagaatgcacctatccgaatacgggtggcagaatcatgatattcttaggaggaccatgctctcagggtcccggccaggtgttgaacgacgatttgaagcagcccatcaggtcccatcatgacatacacaaagacaatgccaagtacatgaagaaggctatcaaacattacgatcacttggcaatgcgagctgccaccaacagccattgcatcgacatttactcctgcgccctggatcagacgggactgatggagatgaagcagtgctgcaattccaccggagggcacatggtcatgggcgattccttcaattcctctctattcaaacaaaccttccagcgagtgttctcaaaagacccgaagaacgacctcaagatggcgttcaacgccaccttggaggtgaagtgttccagggagttaaaagtccaagggggcatcggctcgtgcgtgtccttgaacgttaaaagccctctggtttccgatacggaactaggcatggggaatactgtgcagtggaaactttgcacgttggcgccgagctctactgtggcgctgttcttcgaggtggttaaccagcattcggcgcccataccacagggaggcaggggctgcatccagctcatcacccagtatcagcacgcgagcgggcaaaggaggatcagagtgaccacgattgctagaaattgggcggacgctactgccaacatccaccacattagcgctggcttcgaccaagaagcggcggcagttgtgatggcccgaatggccggttacaaggcggaatcggacgagactcccgacgtgctcagatgggtggacaggatgttgatcaggctgtgccagaagttcggagagtacaataaagacgatccgaattcgttcaggttgggggagaacttcagtctgtatccgcagttcatgtaccatttgagacggtcgcagtttctgcaggtgttcaataattctcctgatgaaacgtcgttttataggcacatgctgatgcgtgaggatttgactcagtctttgatcatgatccagccgattttgtacagttacagcttcaacgggccgcccgagcctgtgttgttggacacaagctctattcagccggatagaatcctgctcatggacactttcttccagatactcattttccatggagagaccattgcccaatggcg

SEQ ID NO: 254 - protein, 530 aa, Phaedon cochleariae
LKDSLQMSLSLLPPNALIGLITFGKMVQVHELGTEGCSKSYVFCGTKDLTAKQVQEMLGIGKGSPNPQQQPGQPGRPGQNPQAAPVPPGSRFLQPVSKCDMNLTDLIGELQKDPWPVHQGKRPLRSTGAALSIAVGLLECTYPNTGGRIMIFLGGPCSQGPGQVLNDDLKQPIRSHHDIHKDNAKYMKKAIKHYDHLAMRAATNSHCIDIYSCALDQTGLMEMKQCCNSTGGHMVMGDSFNSSLFKQTFQRVFSKDPKNDLKMAFNATLEVKCSRELKVQGGIGSCVSLNVKSPLVSDTELGMGNTVQWKLCTLAPSSTVALFFEVVNQHSAPIPQGGRGCIQLITQYQHASGQRRIRVTTIARNWADATANIHHISAGFDQEAAAVVMARMAGYKAESDETPDVLRWVDRMLIRLCQKFGEYNKDDPNSFRLGENFSLYPQFMYHLRRSQFLQVFNNSPDETSFYRHMLMREDLTQSLIMIQPILYSYSFNGPPEPVLLDTSSIQPDRILLMDTFFQILIFHGETIAQW

SEQ ID NO: 255 - DNA, 598 bp, Phaedon cochleariae
ctgatgttcaaaaacaaatcaaacacatgatggctttcattgaacaagaagccaatgagaaagcagaagaaattgatgccaaggcagaggaggaattcaacattgaaaaagggcgtttggtccagcaacagagactcaagatcatggagtactacgagaaaaaggagaagcaagtcgaacttcaaaagaaaattcagtcctctaatatgttgaatcaggctcgtttgaaggtgctgaaagtgagagaggaccatgtcagagcagtcctggaggatgctcgtaaaagtcttggtgaagtaaccaaagaccaaggaaaatactcccaaattttggagagcctaatcctacaaggactgttccagctgttcgagaaggaggtgacggtccgcgtgagaccgcaagacagggacctggtcaggtccatcctgcccaacgtcgctgccaaatacaaggacgccaccggcaaagacatcctactcaaggtggacgatgagtcgcacctgtctcaggagatcaccggaggcgtcgatttgctcgctcagaagaacaagatcaagatcagcaacacgatggaggctaggttggatctgatcgctca

SEQ ID NO: 256 - protein, 198 aa, Phaedon cochleariae
DVQKQIKHMMAFIEQEANEKAEEIDAKAEEEFNIEKGRLVQQQRLKIMEYYEKKEKQVELQKKIQSSNMLNQARLKVLKVREDHVRAVLEDARKSLGEVTKDQGKYSQILESLILQGLFQLFEKEVTVRVRPQDRDLVRSILPNVAAKYKDATGKDILLKVDDESHLSQEITGGVDLLAQKNKIKISNTMEARLDLIA

SEQ ID NO: 257 - DNA, 957 bp, Phaedon cochleariae
ggaataggatgggtgatgtcgtcgttgggcatagtcaagatggggatctgcgtgatggagccgttgcggccctccacacgaccggcgcgctcgtaaatggtggccagatcggtgtacatgtaaccggggaaacccctacggccgggcacttcttctcgagcggcagacacctcacgcaacgcctccgcgtacgacgacatgtcggtcaagatgaccagcacgtgcttctcgcactggtaggccaagaattcggcggccgtcagagccaaacgcggcgtgatgatgcgctcgatggtcggatcgttggccaagttcaagaacagacacacgttctccatcgagccgttctcttcgaagtcctgcttgaagaacctggcagtttccatgttgacacccatagcagcaaacacaatagcaaagttgtcttcatggtcatccagcacagacttgccaggtactttgaccaagccagcctgcctacaaatctgggctgcaatctcattgtggggcagcccagcggcggagaagatcggaatcttctgccctctggcgatagagttcatcacgtcgatggccgtgatcccagtctggatcatttcctcgggataaatacgcgaccacgggttgatcggctgtccttggatgtcgaggtagtcctcagccaggatcgggggacctttatcaatgggttttcctgatccattgaagacacgtcccagcatatcttctgatactggagttcttagaatatctccagtgaactcacacaccgtgttcttagcatcaatacctgatgtgccttcaaatacctgaacaactgcctttgatccactgacttccaaaacttgtccagatcgtagagttccatctgccaatttgagctggacaatttcattgaattttggaaacttgacatcctcaagaatgaccagtggtccgttcacaccagacacagtc

SEQ ID NO: 258 - protein, 302 aa, Phaedon cochleariae
LVILEDVKFPKFNEIVQLKLADGTLRSGQVLEVSGSKAVVQVFEGTSGIDAKNTVCEFTGDILRTPVSEDMLGRVFNGSGKPIDKGPPILAEDYLDIQGQPINPWSRIYPEEMIQTGITAIDVMNSIARGQKIPIFSAAGLPHNEIAAQICRQAGLVKVPGKSVLDDHEDNFAIVFAAMGVNMETARFFKQDFEENGSMENVCLFLNLANDPTIERIITPRLALTAAEFLAYQCEKHVLVILTDMSSYAEALREVSAAREEVPGRRGFPGYMYTDLATIYERAGRVEGRNGSITQIPILTMP

SEQ ID NO: 259 - DNA, 922 bp, Phaedon cochleariae
gggccaagcacagtgaaatacagcaagctaacttgaaagcactaccagaaggagctgaaatcagagatggagaacgtttgccagtcacagtaaaggacatgggagcatgcgagatttacccacaaacaatccaacacaaccccaatgggcggtttgtagtggtttgtggtgatggagaatacataatatacacggctatggcccttcgtaacaaagcatttggtagcgctcaagaatttgtatgggcacaggactccagtgaatatgccatccgcgaatccggatccaccattcgaatcttcaagaatttcaaagaaaaaaagaatttcaagtccgactttggtgccgaaggaatctatggtggttttctcttgggtgtgaaatcagtgtctggcttagctttctatgactgggaaacgcttgagttagtaaggcgcattgaaatacagcctagagctatctactggtcagatagtggcaagttggtatgccttgctaccgaagatagctatttcatattgtcctatgactctgaccaagtccagaaagctagagataacaaccaagttgccgaagatggagtggaggctgcctttgatgtcctaggtgaaataaatgaatccgtaagaacaggtctttgggtaggagactgcttcatttacacaaacgcagtcaaccgtatcaactactttgtgggtggtgaattggtaactattgcacatctggaccgtcctctatatgtcctgggctatgtacctagagatgacaggttatacttggttgataaagagttaggagtagtcagctatcaattgctattatctgtactcgaatatcagactgcagtcatgcgacgagacttcccaacggctgatcgagtattgccttcaattccaaaagaacatcgcactagggtggcaca

SEQ ID NO: 260 - protein, 291 aa, Phaedon cochleariae
  misc_feature (263)..(263): Xaa can be any naturally occurring amino acid
QANLKVLPEGAEIRDGERLPVTVKDMGACEIYPQTIQHNPNGRFVVVCGDGEYIIYTAMALRNKAFGSAQEFVWAQDSSEYAIRESGSTIRIFKNFKEKKNFKSDFGAEGIYGGFLLGVKSVSGLAFYDWETLELVRRIEIQPRAIYWSDSGKLVCLATEDSYFILSYDSDQVQKARDNNQVAEDGVEAAFDVLGEINESVRTGLWVGDCFIYTNAVNRINYFVGGELVTIAHLDRPLYVLGYVPRDDRLYLVDKELGVVSYXIAIICTRISDCSHATRLPNGSSIAFNSK

SEQ ID NO: 261 - DNA, 23 bp, Artificial Sequence
  synthetic oligo
catttgaagcgtttwrmygcycc

SEQ ID NO: 262 - DNA, 28 bp, Artificial Sequence
  synthetic oligo
cttcgtgcccttgccratkatraabacg

SEQ ID NO: 263 - DNA, 26 bp, Artificial Sequence
  synthetic oligo
  misc_feature (18)..(18): n is a, c, g, or t
tcggtcttctcgaagacntaygtkac

SEQ ID NO: 264 - DNA, 27 bp, Artificial Sequence
  synthetic oligo
ccctggttcttcttvrrrttcttcctc

SEQ ID NO: 265 - DNA, 26 bp, Artificial Sequence
  synthetic oligo
tgcgatgcggcaaraaraaggtbtgg

SEQ ID NO: 266 - DNA, 26 bp, Artificial Sequence
  synthetic oligo
tcctgcttcttsgyrgcratwcgytc

SEQ ID NO: 267 - DNA, 25 bp, Artificial Sequence
  synthetic oligo
ctctcaaggattckytrcaratgtc

SEQ ID NO: 268 - DNA, 23 bp, Artificial Sequence
  synthetic oligo
cgccattgggcratggtytckcc

SEQ ID NO: 269 - DNA, 22 bp, Artificial Sequence
  synthetic oligo
cgcagatcaarcayatgatggc

SEQ ID NO: 270 - DNA, 21 bp, Artificial Sequence
  synthetic oligo
cggatctcgggcasmarytgc

SEQ ID NO: 271 - DNA, 24 bp, Artificial Sequence
  synthetic oligo
gactgtgtctggtgtraacggwcc

SEQ ID NO: 272 - DNA, 24 bp, Artificial Sequence
  synthetic oligo
ggaataggatgggtratrtcgtcg

SEQ ID NO: 273 - DNA, 23 bp, Artificial Sequence
  synthetic oligo
gggccaagcacwsygaaatrcag

SEQ ID NO: 274 - DNA, 23 bp, Artificial Sequence
  synthetic oligo
tgtgccaccctagtrcgrtgytc

SEQ ID NO: 275 - DNA, 23 bp, Phaedon cochleariae
aaaattgtcatgcaaaggttgat

SEQ ID NO: 276 - DNA, 21 bp, Phaedon cochleariae
aaagcatggatgttggacaaa

SEQ ID NO: 277 - DNA, 23 bp, Phaedon cochleariae
aaagcatggatgttggacaaatt

SEQ ID NO: 278 - DNA, 26 bp, Phaedon cochleariae
aaagcatggatgttggacaaattggg

SEQ ID NO: 279 - DNA, 32 bp, Phaedon cochleariae
aaagcatggatgttggacaaattggggggtgt

SEQ ID NO: 280 - DNA, 22 bp, Phaedon cochleariae
aaatacaagttgtgtaaagtaa

SEQ ID NO: 281 - DNA, 31 bp, Phaedon cochleariae
aagcatggatgttggacaaattggggggtgt

SEQ ID NO: 282 - DNA, 23 bp, Phaedon cochleariae
atggatgtcattactattgagaa

SEQ ID NO: 283 - DNA, 24 bp, Phaedon cochleariae
catcaaatttgaatctggcaacct

SEQ ID NO: 284 - DNA, 23 bp, Phaedon cochleariae
catgatggcagaaccattcgtta

SEQ ID NO: 285 - DNA, 22 bp, Phaedon cochleariae
ccaaagcatggatgttggacaa

SEQ ID NO: 286 - DNA, 23 bp, Phaedon cochleariae
ccatttttggtaacacatgatgg

SEQ ID NO: 287 - DNA, 23 bp, Phaedon cochleariae
cccaaagcatggatgttggacaa

SEQ ID NO: 288 - DNA, 24 bp, Phaedon cochleariae
cccaaagcatggatgttggacaaa

SEQ ID NO: 289 - DNA, 26 bp, Phaedon cochleariae
cccaaagcatggatgttggacaaatt

SEQ ID NO: 290 - DNA, 29 bp, Phaedon cochleariae
cccaaagcatggatgttggacaaattggg

SEQ ID NO: 291 - DNA, 35 bp, Phaedon cochleariae
cccaaagcatggatgttggacaaattggggggtgt

SEQ ID NO: 292 - DNA, 41 bp, Phaedon cochleariae
cccaaagcatggatgttggacaaattggggggtgtcttcgc

SEQ ID NO: 293 - DNA, 23 bp, Phaedon cochleariae
cgttaccctgaccccaacatcaa

SEQ ID NO: 294 - DNA, 25 bp, Phaedon cochleariae
gcaaaatacaagttgtgtaaagtaa

SEQ ID NO: 295 - DNA, 23 bp, Phaedon cochleariae
gcatggatgttggacaaattggg

SEQ ID NO: 296 - DNA, 25 bp, Phaedon cochleariae
gcatggatgttggacaaattggggg

SEQ ID NO: 297 - DNA, 29 bp, Phaedon cochleariae
gcatggatgttggacaaattggggggtgt

SEQ ID NO: 298 - DNA, 31 bp, Phaedon cochleariae
gcatggatgttggacaaattggggggtgtct

SEQ ID NO: 299 - DNA, 23 bp, Phaedon cochleariae
gctcccaaagcatggatgttgga

SEQ ID NO: 300 - DNA, 26 bp, Phaedon cochleariae
gctcccaaagcatggatgttggacaa

SEQ ID NO: 301 - DNA, 27 bp, Phaedon cochleariae
gctcccaaagcatggatgttggacaaa

SEQ ID NO: 302 - DNA, 32 bp, Phaedon cochleariae
gctcccaaagcatggatgttggacaaattggg

SEQ ID NO: 303 - DNA, 26 bp, Phaedon cochleariae
ggtcccaaaggaatcccatttttggt

SEQ ID NO: 304 - DNA, 21 bp, Phaedon cochleariae
ggtgtcttcgcccctcgtcca

SEQ ID NO: 305 - DNA, 28 bp, Phaedon cochleariae
gtgaagtcactaaaattgtcatgcaaag

SEQ ID NO: 306 - DNA, 23 bp, Phaedon cochleariae
tccaccgggcctcacaagttgcg

SEQ ID NO: 307 - DNA, 21 bp, Phaedon cochleariae
tcccaaagcatggatgttgga

SEQ ID NO: 308 - DNA, 27 bp, Phaedon cochleariae
tgctcccaaagcatggatgttggacaa

SEQ ID NO: 309 - DNA, 28 bp, Phaedon cochleariae
tggatgttggacaaattggggggtgtct

SEQ ID NO: 310 - DNA, 21 bp, Phaedon cochleariae
aaaattgaagatttcttggaa

SEQ ID NO: 311 - DNA, 23 bp, Phaedon cochleariae
aacaaacgtgaagtgtggagagt

SEQ ID NO: 312 - DNA, 23 bp, Phaedon cochleariae
aagtcgcccttcgggggtggccg

SEQ ID NO: 313 - DNA, 25 bp, Phaedon cochleariae
acttctccctgaagtcgcccttcgg

SEQ ID NO: 314 - DNA, 26 bp, Phaedon cochleariae
agattgtttgaaggtaatgcacttct

SEQ ID NO: 315 - DNA, 21 bp, Phaedon cochleariae
atccgtaaagctgctcgtgaa

SEQ ID NO: 316 - DNA, 23 bp, Phaedon cochleariae
atcgacttctccctgaagtcgcc

SEQ ID NO: 317 - DNA, 25 bp, Phaedon cochleariae
atcgacttctccctgaagtcgccct

SEQ ID NO: 318 - DNA, 51 bp, Phaedon cochleariae
atgaagcttgattatgttttgggtctgaaaattgaagatttcttggaaaga

SEQ ID NO: 319 - DNA, 21 bp, Phaedon cochleariae
attgaagatttcttggaaaga

SEQ ID NO: 320 - DNA, 23 bp, Phaedon cochleariae
cacatcgacttctccctgaagtc

SEQ ID NO: 321 - DNA, 38 bp, Phaedon cochleariae
cagaagcacatcgacttctccctgaagtcgcccttcgg

SEQ ID NO: 322 - DNA, 41 bp, Phaedon cochleariae
cagaagcacatcgacttctccctgaagtcgcccttcggggg

SEQ ID NO: 323 - DNA, 21 bp, Phaedon cochleariae
cgacttctccctgaagtcgcc

SEQ ID NO: 324 - DNA, 21 bp, Phaedon cochleariae
ctccctgaagtcgcccttcgg

SEQ ID NO: 325 - DNA, 35 bp, Phaedon cochleariae
ctggactcgcagaagcacatcgacttctccctgaa

SEQ ID NO: 326 - DNA, 26 bp, Phaedon cochleariae
gacttctccctgaagtcgcccttcgg

SEQ ID NO: 327 - DNA, 26 bp, Phaedon cochleariae
gctaaaatccgtaaagctgctcgtga

SEQ ID NO: 328 - DNA, 29 bp, Phaedon cochleariae
gctaaaatccgtaaagctgctcgtgaact

SEQ ID NO: 329 - DNA, 26 bp, Phaedon cochleariae
gtgcgcaagcaggtggtgaacatccc

SEQ ID NO: 330 - DNA, 29 bp, Phaedon cochleariae
tacactttggctaaaatccgtaaagctgc

SEQ ID NO: 331 - DNA, 23 bp, Phaedon cochleariae
tcgcagaagcacatcgacttctc

SEQ ID NO: 332 - DNA, 41 bp, Phaedon cochleariae
tcgcagaagcacatcgacttctccctgaagtcgcccttcgg

SEQ ID NO: 333 - DNA, 22 bp, Phaedon cochleariae
tctccctgaagtcgcccttcgg

SEQ ID NO: 334 - DNA, 23 bp, Phaedon cochleariae
tgaaaattgaagatttcttggaa

SEQ ID NO: 335 - DNA, 26 bp, Phaedon cochleariae
tgaaaattgaagatttcttggaaaga

SEQ ID NO: 336 - DNA, 31 bp, Phaedon cochleariae
tggactcgcagaagcacatcgacttctccct

SEQ ID NO: 337 - DNA, 22 bp, Phaedon cochleariae
tggctaaaatccgtaaagctgc

SEQ ID NO: 338 - DNA, 28 bp, Phaedon cochleariae
tgggtctgaaaattgaagatttcttgga

SEQ ID NO: 339 - DNA, 23 bp, Phaedon cochleariae
ttctccctgaagtcgcccttcgg

SEQ ID NO: 340 - DNA, 32 bp, Phaedon cochleariae
ttgggtctgaaaattgaagatttcttggaaag

SEQ ID NO: 341 - DNA, 23 bp, Phaedon cochleariae
gggtgcgcaagcaggtggtgaac

SEQ ID NO: 342 - DNA, 29 bp, Phaedon cochleariae
ctcctcaaaaagtacagggaggccaagaa

SEQ ID NO: 343 - DNA, 23 bp, Phaedon cochleariae
aaaaagaaggtgtggttggatcc

SEQ ID NO: 344 - DNA, 35 bp, Phaedon cochleariae
aaaaagaaggtgtggttggatccaaatgaaatcaa

SEQ ID NO: 345 - DNA, 32 bp, Phaedon cochleariae
aaagaaggtgtggttggatccaaatgaaatca

SEQ ID NO: 346 - DNA, 23 bp, Phaedon cochleariae
aacaccaactcaagacaaaacat

SEQ ID NO: 347 - DNA, 29 bp, Phaedon cochleariae
aacaccaactcaagacaaaacatccgtaa

SEQ ID NO: 348 - DNA, 23 bp, Phaedon cochleariae
aactcaagacaaaacatccgtaa

SEQ ID NO: 349 - DNA, 38 bp, Phaedon cochleariae
aagaacactgaagccagaaggaagggaaggcattgtgg

SEQ ID NO: 350 - DNA, 26 bp, Phaedon cochleariae
aatgaaatcaacgaaatcgccaacac

SEQ ID NO: 351 - DNA, 26 bp, Phaedon cochleariae
atggagtacatccacaagaagaaggc

SEQ ID NO: 352 - DNA, 21 bp, Phaedon cochleariae
caagatgctgtctgaccaggc

SEQ ID NO: 353 - DNA, 26 bp, Phaedon cochleariae
cgcctcctcaaaaagtacagggaggc

SEQ ID NO: 354 - DNA, 21 bp, Phaedon cochleariae
cgtatcgccaccaagaagcag

SEQ ID NO: 355 - DNA, 23 bp, Phaedon cochleariae
ctgtacatgaaagcgaagggtaa

SEQ ID NO: 356 - DNA, 22 bp, Phaedon cochleariae
gaacaagagggtccttatggag

SEQ ID NO: 357 - DNA, 30 bp, Phaedon cochleariae
gaacaagagggtccttatggagtacatcca

SEQ ID NO: 358 - DNA, 23 bp, Phaedon cochleariae
gagcgtatcgccaccaagaagca

SEQ ID NO: 359 - DNA, 23 bp, Phaedon cochleariae
gagtacatccacaagaagaaggc

SEQ ID NO: 360 - DNA, 23 bp, Phaedon cochleariae
gatccaaatgaaatcaacgaaat

SEQ ID NO: 361 - DNA, 29 bp, Phaedon cochleariae
gccaacaccaactcaagacaaaacatccg

SEQ ID NO: 362 - DNA, 38 bp, Phaedon cochleariae
gccaacaccaactcaagacaaaacatccgtaagctcat

SEQ ID NO: 363 - DNA, 37 bp, Phaedon cochleariae
ggcaaaaagaaggtgtggttggatccaaatgaaatca

SEQ ID NO: 364 - DNA, 28 bp, Phaedon cochleariae
gggtccttatggagtacatccacaagaa

SEQ ID NO: 365 - DNA, 22 bp, Phaedon cochleariae
tgcgatgcggcaaaaagaaggt

SEQ ID NO: 366 - DNA, 29 bp, Phaedon cochleariae
tggttggatccaaatgaaatcaacgaaat

SEQ ID NO: 367 - DNA, 26 bp, Phaedon cochleariae
ttggatccaaatgaaatcaacgaaat

SEQ ID NO: 368 - DNA, 21 bp, Phaedon cochleariae
ccgcagttcatgtaccatttg

SEQ ID NO: 369 - DNA, 29 bp, Phaedon cochleariae
ctgatggagatgaagcagtgctgcaattc

SEQ ID NO: 370 - DNA, 23 bp, Phaedon cochleariae
gacgtgctcagatgggtggacag

SEQ ID NO: 371 - DNA, 21 bp, Phaedon cochleariae
gcccgagcctgtgttgttgga

SEQ ID NO: 372 - DNA, 23 bp, Phaedon cochleariae
ggcacatgctgatgcgtgaggat

SEQ ID NO: 373 - DNA, 23 bp, Phaedon cochleariae
gggcacatggtcatgggcgattc

SEQ ID NO: 374 - DNA, 23 bp, Phaedon cochleariae
aagatcatggagtactacgagaa

SEQ ID NO: 375 - DNA, 21 bp, Phaedon cochleariae
acgagaaaaaggagaagcaag

SEQ ID NO: 376 - DNA, 32 bp, Phaedon cochleariae
atggagtactacgagaaaaaggagaagcaagt

SEQ ID NO: 377 - DNA, 26 bp, Phaedon cochleariae
caaaaacaaatcaaacacatgatggc

SEQ ID NO: 378 - DNA, 23 bp, Phaedon cochleariae
ctcaagatcatggagtactacga

SEQ ID NO: 379 - DNA, 26 bp, Phaedon cochleariae
ctcaagatcatggagtactacgagaa

SEQ ID NO: 380 - DNA, 23 bp, Phaedon cochleariae
gaacaagaagccaatgagaaagc

SEQ ID NO: 381 - DNA, 21 bp, Phaedon cochleariae
gactcaagatcatggagtact

SEQ ID NO: 382 - DNA, 32 bp, Phaedon cochleariae
gatgttcaaaaacaaatcaaacacatgatggc

SEQ ID NO: 383 - DNA, 22 bp, Phaedon cochleariae
tactacgagaaaaaggagaagc

SEQ ID NO: 384 - DNA, 23 bp, Phaedon cochleariae
ttcattgaacaagaagccaatga

SEQ ID NO: 385 - DNA, 23 bp, Phaedon cochleariae
acacgaccggcgcgctcgtaaat

SEQ ID NO: 386 - DNA, 41 bp, Phaedon cochleariae
accagcacgtgcttctcgcactggtaggccaagaattcggc

SEQ ID NO: 387 - DNA, 26 bp, Phaedon cochleariae
agcacgtgcttctcgcactggtaggc

SEQ ID NO: 388 - DNA, 23 bp, Phaedon cochleariae
atacgcgaccacgggttgatcgg

SEQ ID NO: 389 - DNA, 27 bp, Phaedon cochleariae
atcggtgtacatgtaaccggggaaacc

SEQ ID NO: 390 - DNA, 24 bp, Phaedon cochleariae
atcgttggccaagttcaagaacag

SEQ ID NO: 391 - DNA, 30 bp, Phaedon cochleariae
cacgtgcttctcgcactggtaggccaagaa

SEQ ID NO: 392 - DNA, 23 bp, Phaedon cochleariae
ccagtctggatcatttcctcggg

SEQ ID NO: 393 - DNA, 26 bp, Phaedon cochleariae
ccagtctggatcatttcctcgggata

SEQ ID NO: 394 - DNA, 37 bp, Phaedon cochleariae
cgctcgatggtcggatcgttggccaagttcaagaaca

SEQ ID NO: 395 - DNA, 53 bp, Phaedon cochleariae
cgctcgatggtcggatcgttggccaagttcaagaacagacacacgttctccat

SEQ ID NO: 396 - DNA, 28 bp, Phaedon cochleariae
cgtgcttctcgcactggtaggccaagaa

SEQ ID NO: 397 - DNA, 29 bp, Phaedon cochleariae
ctggcagtttccatgttgacacccatagc

SEQ ID NO: 398 - DNA, 21 bp, Phaedon cochleariae
cttagcatcaatacctgatgt

SEQ ID NO: 399 - DNA, 29 bp, Phaedon cochleariae
gacatgtcggtcaagatgaccagcacgtg

SEQ ID NO: 400 - DNA, 41 bp, Phaedon cochleariae
gacatgtcggtcaagatgaccagcacgtgcttctcgcactg

SEQ ID NO: 401 - DNA, 44 bp, Phaedon cochleariae
gacatgtcggtcaagatgaccagcacgtgcttctcgcactggta

SEQ ID NO: 402 - DNA, 23 bp, Phaedon cochleariae
gagccgttctcttcgaagtcctg

SEQ ID NO: 403 - DNA, 21 bp, Phaedon cochleariae
gatgaccagcacgtgcttctc

SEQ ID NO: 404 - DNA, 27 bp, Phaedon cochleariae
gatgaccagcacgtgcttctcgcactg

SEQ ID NO: 405 - DNA, 39 bp, Phaedon cochleariae
gatgaccagcacgtgcttctcgcactggtaggccaagaa

SEQ ID NO: 406 - DNA, 45 bp, Phaedon cochleariae
gatgaccagcacgtgcttctcgcactggtaggccaagaattcggc

SEQ ID NO: 407 - DNA, 21 bp, Phaedon cochleariae
gatggggatctgcgtgatgga

SEQ ID NO: 408 - DNA, 39 bp, Phaedon cochleariae
gatggggatctgcgtgatggagccgttgcggccctccac

SEQ ID NO: 409 - DNA, 35 bp, Phaedon cochleariae
ggaataggatgggtgatgtcgtcgttgggcatagt

SEQ ID NO: 410 - DNA, 37 bp, Phaedon cochleariae
ggaataggatgggtgatgtcgtcgttgggcatagtca

SEQ ID NO: 411 - DNA, 23 bp, Phaedon cochleariae
ggatcgttggccaagttcaagaa

SEQ ID NO: 412 - DNA, 25 bp, Phaedon cochleariae
ggatcgttggccaagttcaagaaca

SEQ ID NO: 413 - DNA, 26 bp, Phaedon cochleariae
ggatcgttggccaagttcaagaacag

SEQ ID NO: 414 - DNA, 26 bp, Phaedon cochleariae
ggatgggtgatgtcgtcgttgggcat

SEQ ID NO: 415 - DNA, 27 bp, Phaedon cochleariae
ggcagtttccatgttgacacccatagc

SEQ ID NO: 416 - DNA, 23 bp, Phaedon cochleariae
ggcatagtcaagatggggatctg

SEQ ID NO: 417 - DNA, 23 bp, Phaedon cochleariae
gtctggatcatttcctcgggata

SEQ ID NO: 418 - DNA, 62 bp, Phaedon cochleariae
gtgatgatgcgctcgatggtcggatcgttggccaagttcaagaacagacacacgttctccat

SEQ ID NO: 419 - DNA, 23 bp, Phaedon cochleariae
gtgtacatgtaaccggggaaacc

SEQ ID NO: 420 - DNA, 23 bp, Phaedon cochleariae
gtttccatgttgacacccatagc

SEQ ID NO: 421 - DNA, 26 bp, Phaedon cochleariae
tcaatgggttttcctgatccattgaa

SEQ ID NO: 422 - DNA, 22 bp, Phaedon cochleariae
tcatccagcacagacttgccag

SEQ ID NO: 423 - DNA, 23 bp, Phaedon cochleariae
tcatccagcacagacttgccagg

SEQ ID NO: 424 - DNA, 23 bp, Phaedon cochleariae
tccatgttgacacccatagcagc

SEQ ID NO: 425 - DNA, 29 bp, Phaedon cochleariae
tccatgttgacacccatagcagcaaacac

SEQ ID NO: 426 - DNA, 26 bp, Phaedon cochleariae
tcgaagtcctgcttgaagaacctggc

SEQ ID NO: 427 - DNA, 50 bp, Phaedon cochleariae
tcgatggtcggatcgttggccaagttcaagaacagacacacgttctccat

SEQ ID NO: 428 - DNA, 43 bp, Phaedon cochleariae
tcggatcgttggccaagttcaagaacagacacacgttctccat

SEQ ID NO: 429 - DNA, 23 bp, Phaedon cochleariae
tcgttggccaagttcaagaacag

SEQ ID NO: 430 - DNA, 23 bp, Phaedon cochleariae
tgggtgatgtcgtcgttgggcat

SEQ ID NO: 431 - DNA, 23 bp, Phaedon cochleariae
ttctcgcactggtaggccaagaa

SEQ ID NO: 432 - DNA, 32 bp, Phaedon cochleariae
ttctcttcgaagtcctgcttgaagaacctggc

SEQ ID NO: 433 - DNA, 29 bp, Phaedon cochleariae
ttggccaagttcaagaacagacacacgtt

SEQ ID NO: 434 - DNA, 29 bp, Phaedon cochleariae
gtttccatgttgacacccatagcagcaaa

SEQ ID NO: 435 - DNA, 21 bp, Phaedon cochleariae
atggatgttggacaaattggg

SEQ ID NO: 436 - DNA, 29 bp, Phaedon cochleariae
gctaaaatccgtaaagctgctcgtgaact

SEQ ID NO: 437 - DNA, 23 bp, Phaedon cochleariae
gagtaaagtacactttggctaaa

SEQ ID NO: 438 - DNA, 26 bp, Phaedon cochleariae
aaaatccgtaaagctgctcgtgaact

SEQ ID NO: 439 - DNA, 26 bp, Phaedon cochleariae
ctggactcgcagaagcacatcgactt

SEQ ID NO: 440 - DNA, 21 bp, Phaedon cochleariae
cgtctggatcaggaattgaaa

SEQ ID NO: 441 - DNA, 23 bp, Phaedon cochleariae
tggttggatccaaatgaaatcaa

SEQ ID NO: 442 - DNA, 26 bp, Phaedon cochleariae
gtgtggttggatccaaatgaaatcaa

SEQ ID NO: 443 - DNA, 29 bp, Phaedon cochleariae
cacatgatggctttcattgaacaagaagc

SEQ ID NO: 444 - DNA, 23 bp, Phaedon cochleariae
tacgagaaaaaggagaagcaagt

SEQ ID NO: 445 - DNA, 26 bp, Phaedon cochleariae
gtctggatcatttcctcgggataaat

SEQ ID NO: 446 - DNA, 26 bp, Phaedon cochleariae
ccagtctggatcatttcctcgggata

SEQ ID NO: 447 - DNA, 24 bp, Phaedon cochleariae
ccctgctggtttcatggatgtcat

SEQ ID NO: 448 - DNA, 23 bp, Phaedon cochleariae
attgaagatttcttggaaagaag

SEQ ID NO: 449 - DNA, 22 bp, Phaedon cochleariae
ttgaagatttcttggaaagaag

SEQ ID NO: 450 - DNA, 22 bp, Phaedon cochleariae
cttctttccaagaaatcttcaa

SEQ ID NO: 451 - DNA, 23 bp, Phaedon cochleariae
gactcgcagaagcacatcgactt

SEQ ID NO: 452 - DNA, 24 bp, Phaedon cochleariae
gactcgcagaagcacatcgacttc

SEQ ID NO: 453 - DNA, 21 bp, Phaedon cochleariae
tcgcagaagcacatcgacttc

SEQ ID NO: 454 - DNA, 23 bp, Phaedon cochleariae
cagaagcacatcgacttctccct

SEQ ID NO: 455 - DNA, 21 bp, Phaedon cochleariae
cttatggagtacatccacaag

SEQ ID NO: 456 - DNA, 22 bp, Phaedon cochleariae
aagaagaaggcagagaaggcca

SEQ ID NO: 457 - DNA, 23 bp, Phaedon cochleariae
gtgttcaataattctcctgatga

SEQ ID NO: 458 - DNA, 23 bp, Phaedon cochleariae
attttccatggagagaccattgc

SEQ ID NO: 459 - DNA, 21 bp, Phaedon cochleariae
gggcagaatccccaagctgcc

SEQ ID NO: 460 - DNA, 21 bp, Phaedon cochleariae
aatacaaggacgccaccggca

SEQ ID NO: 461 - DNA, 23 bp, Phaedon cochleariae
atgcccaacgacgacatcaccca

SEQ ID NO: 462 - DNA, 23 bp, Phaedon cochleariae
tgggtgatgtcgtcgttgggcat

SEQ ID NO: 463 - DNA, 23 bp, Phaedon cochleariae
ggtttccccggttacatgtacac

SEQ ID NO: 464 - DNA, 23 bp, Phaedon cochleariae
actatgcccaacgacgacatcac

SEQ ID NO: 465 - DNA, 23 bp, Phaedon cochleariae
ccgggcacttcttctcgagcggc

SEQ ID NO: 466 - DNA, 23 bp, Phaedon cochleariae
ccgaccatcgagcgcatcatcac

SEQ ID NO: 467 - DNA, 23 bp, Phaedon cochleariae
ttcttgaacttggccaacgatcc

SEQ ID NO: 468 - DNA, 22 bp, Phaedon cochleariae
tgttcttgaacttggccaacga

SEQ ID NO: 469 - DNA, 26 bp, Phaedon cochleariae
gctatgggtgtcaacatggaaactgc

SEQ ID NO: 470 - DNA, 21 bp, Phaedon cochleariae
tgctatgggtgtcaacatgga

SEQ ID NO: 471 - DNA, 25 bp, Phaedon cochleariae
ctattgtgtttgctgctatgggtgt

SEQ ID NO: 472 - DNA, 23 bp, Phaedon cochleariae
tacgagcgcgccggtcgtgtgga

SEQ ID NO: 473 - DNA, 483 bp, Phaedon cochleariae
gcatggatgttggacaaattggggggtgtcttcgcccctcgtccatccaccgggcctcacaagttgcgcgaatccctgcctttagtgattttccttcgtaacaggctgaagtatgcccttacaaacagtgaagtcactaaaattgtcatgcaaaggttgatcaaagttgatggtaaagtgaggactgattctaattaccctgctggtttcatggatgtcattactattgagaagactggtgaatttttccgtctgatctatgatgttaaaggaagatttgctgtgcaccgtattacagctgaagaggcaaaatacaagttgtgtaaagtaaggagagtccaaactggtcccaaaggaatcccatttttggtaacacatgatggcagaaccattcgttaccctgaccccaacatcaaagtgaatgacacaattcaaatggaaattgctacatctaaaattcttgactacatcaaatttgaatct

SEQ ID NO: 474 - DNA, 23 bp, Artificial Sequence
  synthetic oligo
gcatggatgttggacaaattggg

SEQ ID NO: 475 - DNA, 54 bp, Artificial Sequence
  synthetic oligo
gcgtaatacgactcactataggagattcaaatttgatgtagtcaagaattttag

SEQ ID NO: 476 - DNA, 45 bp, Artificial Sequence
  synthetic oligo
gcgtaatacgactcactatagggcatggatgttggacaaattggg

SEQ ID NO: 477 - DNA, 32 bp, Artificial Sequence
  synthetic oligo
agattcaaatttgatgtagtcaagaattttag

SEQ ID NO: 478 - DNA, 477 bp, Phaedon cochleariae; identical to SEQ ID NO: 249

SEQ ID NO: 479 - DNA, 26 bp, Artificial Sequence
  synthetic oligo
ccctagacgtccctatgaaaaggccc

SEQ ID NO: 480 - DNA, 45 bp, Artificial Sequence
  synthetic oligo
gcgtaatacgactcactataggttgacacggccaggtcggccacc

SEQ ID NO: 481 - DNA, 48 bp, Phaedon cochleariae
gcgtaatacgactcactataggccctagacgtccctatgaaaaggccc

SEQ ID NO: 482 - DNA, 23 bp, Artificial Sequence
  synthetic oligo
ttgacacggccaggtcggccacc

SEQ ID NO: 483 - DNA, 449 bp, Phaedon cochleariae
atcctaatgaaatcaacgaaatcgccaacaccaactcaagacaaaacatccgtaagctcatcaaggatggtcttatcatcaagaagccagtggcagtacactctagggcccgtgtacgcaagaacactgaagctagaaggaagggaaggcattgtggatttggaaagaggaagggtacggcaaatgcccgtatgcctcaaaaggaactgtgggtgcagcgcatgcgcgtcctcaggcgcctcctcaaaaagtacagggaggccaagaaaatcgaccgccatctttaccacgccctgtacatgaaagcgaagggtaacgtgttcaggaacaagagggtccttatggagtacatccacaagaagaaggcagagaaggccagggccaagatgctgtctgaccaggctaacgccaggagattgaaggtgaagcaggccagggaacgtagggaa

SEQ ID NO: 484 - DNA, 26 bp, Artificial Sequence
  synthetic oligo
atcctaatgaaatcaacgaaatcgcc

SEQ ID NO: 485 - DNA, 47 bp, Artificial Sequence
  synthetic oligo
gcgtaatacgactcactataggttccctacgttccctggcctgcttc

SEQ ID NO: 486 - DNA, 48 bp, Artificial Sequence
  synthetic oligo
gcgtaatacgactcactataggatcctaatgaaatcaacgaaatcgcc

SEQ ID NO: 487 - DNA, 25 bp, Artificial Sequence
  synthetic oligo
ttccctacgttccctggcctgcttc

SEQ ID NO: 488 - DNA, 1546 bp, Phaedon cochleariae
gctcagcctattaccgcccaacgcgttgattggattgatcacgttcggaaaaatggtgcaagtccacgaactgggtaccgaaggctgcagcaagtcgtacgtgttctgtggaacgaaagatctcaccgccaagcaagtccaggagatgttgggcattggaaaagggtcaccaaatccccaacaacagccagggcaacctgggcggccagggcagaatccccaagctgcccctgtaccaccggggagcagattcttgcagcccgtgtcaaaatgcgacatgaacttgacagatctgatcggggagttgcagaaagacccttggcccgtacatcagggcaaaagacctcttagatccacaggcgcagcattgtccatcgctgtcggcctcttagaatgcacctatccgaatacgggtggcagaatcatgatattcttaggaggaccatgctctcagggtcccggccaggtgttgaacgacgatttgaagcagcccatcaggtcccatcatgacatacacaaagacaatgccaagtacatgaagaaggctatcaaacattacgatcacttggcaatgcgagctgccaccaacagccattgcatcgacatttactcctgcgccctggatcagacgggactgatggagatgaagcagtgctgcaattccaccggagggcacatggtcatgggcgattccttcaattcctctctattcaaacaaaccttccagcgagtgttctcaaaagacccgaagaacgacctcaagatggcgttcaacgccaccttggaggtgaagtgttccagggagttaaaagtccaagggggcatcggctcgtgcgtgtccttgaacgttaaaagccctctggtttccgatacggaactaggcatggggaatactgtgcagtggaaactttgcacgttggcgccgagctctactgtggcgctgttcttcgaggtggttaaccagcattcggcgcccataccacagggaggcaggggctgcatccagctcatcacccagtatcagcacgcgagcgggcaaaggaggatcagagtgaccacgattgctagaaattgggcggacgctactgccaacatccaccacattagcgctggcttcgaccaagaagcggcggcagttgtgatggcccgaatggccggttacaaggcggaatcggacgagactcccgacgtgctcagatgggtggacaggatgttgatcaggctgtgccagaagttcggagagtacaataaagacgatccgaattcgttcaggttgggggagaacttcagtctgtatccgcagttcatgtaccatttgagacggtcgcagtttctgcaggtgttcaataattctcctgatgaaacgtcgttttataggcacatgctgatgcgtgaggatttgactcagtctttgatcatgatccagccgattttgtacagttacagcttcaacgggccgcccgagcctgtgttgttggacacaagctctattcagccggatagaatcctgctcatggacactttcttccagatactcattttccat

SEQ ID NO: 489 - DNA, 24 bp, Artificial Sequence
  synthetic oligo
gctcagcctattaccgcccaacgc

SEQ ID NO: 490 - DNA, 48 bp, Artificial Sequence
  synthetic oligo
gcgtaatacgactcactataggatggaaaatgagtatctggaagaaag

SEQ ID NO: 491 - DNA, 46 bp, Artificial Sequence
  synthetic oligo
gcgtaatacgactcactatagggctcagcctattaccgcccaacgc

SEQ ID NO: 492 - DNA, 26 bp, Artificial Sequence
  synthetic oligo
atggaaaatgagtatctggaagaaag

SEQ ID NO: 493 - DNA, 598 bp, Phaedon cochleariae; identical to SEQ ID NO: 255

SEQ ID NO: 494 - DNA, 29 bp, Artificial Sequence
  synthetic oligo
ctgatgttcaaaaacaaatcaaacacatg

SEQ ID NO: 495 - DNA, 49 bp, Artificial Sequence
  synthetic oligo
gcgtaatacgactcactataggtgagcgatcagatccaacctagcctcc

SEQ ID NO: 496 - DNA, 51 bp, Artificial Sequence
  synthetic oligo
gcgtaatacgactcactataggctgatgttcaaaaacaaatcaaacacatg

SEQ ID NO: 497 - DNA, 27 bp, Artificial Sequence
  synthetic oligo
tgagcgatcagatccaacctagcctcc

SEQ ID NO: 498 - DNA, 909 bp, Phaedon cochleariae
actggtcattcttgaggatgtcaagtttccaaaattcaatgaaattgtccagctcaaattggcagatggaactctacgatctggacaagttttggaagtcagtggatcaaaggcagttgttcaggtatttgaaggcacatcaggtattgatgctaagaacacggtgtgtgagttcactggagatattctaagaactccagtatcagaagatatgctgggacgtgtcttcaatggatcaggaaaacccattgataaaggtcccccgatcctggctgaggactacctcgacatccaaggacagccgatcaacccgtggtcgcgtatttatcccgaggaaatgatccagactgggatcacggccatcgacgtgatgaactctatcgccagagggcagaagattccgatcttctccgccgctgggctgccccacaatgagattgcagcccagatttgtaggcaggctggcttggtcaaagtacctggcaagtctgtgctggatgaccatgaagacaactttgctattgtgtttgctgctatgggtgtcaacatggaaactgccaggttcttcaagcaggacttcgaagagaacggctcgatggagaacgtgtgtctgttcttgaacttggccaacgatccgaccatcgagcgcatcatcacgccgcgtttggctctgacggccgccgaattcttggcctaccagtgcgagaagcacgtgctggtcatcttgaccgacatgtcgtcgtacgcggaggcgttgcgtgaggtgtctgccgctcgagaagaagtgcccggccgtaggggtttccccggttacatgtacaccgatctggccaccatttacgagcgcgccggtcgtgtggagggccgcaacggctccatcacgcagatccccatcttgactatgcccaa

SEQ ID NO: 499 - DNA, 26 bp, Artificial Sequence
  synthetic oligo
actggtcattcttgaggatgtcaagt

SEQ ID NO: 500 - DNA, 49 bp, Artificial Sequence
  synthetic oligo
gcgtaatacgactcactataggttgggcatagtcaagatggggatctgc

SEQ ID NO: 501 - DNA, 48 bp, Artificial Sequence
  synthetic oligo
gcgtaatacgactcactataggactggtcattcttgaggatgtcaagt

SEQ ID NO: 502 - DNA, 27 bp, Artificial Sequence
  synthetic oligo
ttgggcatagtcaagatggggatctgc

SEQ ID NO: 503 - DNA, 877 bp, Phaedon cochleariae
  misc_feature (788)..(788): n is a, c, g, or t
caagctaacttgaaagtactaccagaaggagctgaaatcagagatggagaacgtttgccagtcacagtaaaggacatgggagcatgcgagatttacccacaaacaatccaacacaaccccaatgggcggtttgtagtggtttgtggtgatggagaatacataatatacacggctatggcccttcgtaacaaagcatttggtagcgctcaagaatttgtatgggcacaggactccagtgaatatgccatccgcgaatccggatccaccattcgaatcttcaagaatttcaaagaaaaaaagaatttcaagtccgactttggtgccgaaggaatctatggtggttttctcttgggtgtgaaatcagtttctggcttagctttctatgactgggaaacgcttgagttagtaaggcgcattgaaatacagcctagagctatctactggtcagatagtggcaagttggtatgccttgctaccgaagatagctatttcatattgtcctatgactctgaccaagtccagaaagctagagataacaaccaagttgctgaagatggagtggaggctgcctttgatgtcctaggtgaaataaatgaatccgtaagaacaggtctttgggtaggagactgcttcatttacacaaacgcagtcaaccgtatcaactactttgtgggtggtgaattggtaactattgcacatctggaccgtcctctatatgtcctgggctatgtacctagagatgacaggttatacttggttgataaagagttaggagtagtcagctatcnaattgctattatctgtactcgaatatcagactgcagtcatgcgacgagacttcccaacggctgatcgagtattgccttcaattccaaaa

SEQ ID NO: 504 - DNA, 29 bp, Artificial Sequence
  synthetic oligo
caagctaacttgaaagtactaccagaagg

SEQ ID NO: 505 - DNA, 51 bp, Artificial Sequence
  synthetic oligo
gcgtaatacgactcactataggttttggaattgaaggcaatactcgatcag

SEQ ID NO: 506 - DNA, 51 bp, Artificial Sequence
  synthetic oligo
gcgtaatacgactcactataggcaagctaacttgaaagtactaccagaagg

SEQ ID NO: 507 - DNA, 29 bp, Artificial Sequence
  synthetic oligo
ttttggaattgaaggcaatactcgatcag

SEQ ID NO: 508 - DNA, 2478 bp, Phaedon cochleariae
agattcaaatttgatgtagtcaagaattttagatgtagcaatttccatttgaattgtgtcattcactttgatgttggggtcagggtaacgaatggttctgccatcatgtgttaccaaaaatgggattcctttgggaccagtttggactctccttactttacacaacttgtattttgcctcttcagctgtaatacggtgcacagcaaatcttcctttaacatcatagatcagacggaaaaattcaccagtcttctcaatagtaatgacatccatgaaaccagcagggtaattagaatcagtcctcactttaccatcaactttgatcaacctttgcatgacaattttagtgacttcactgtttgtaagggcatacttcagcctgttacgaaggaaaatcactaaaggcagggattcgcgcaacttgtgaggcccggtggatggacgaggggcgaagacaccccccaatttgtccaacatccatgcaagggcgaattcgacccagctttcttgtacaaagtggtgatatcactagtgcggccgcctgcaggtcgaccatatggtcgacctgcaggcggccgcactagtgatgctgttatgttcagtgtcaagctgacctgcaaacacgttaaatgctaagaagttagaatatatgagacacgttaactggtatatgaataagctgtaaataaccgagtataaactcattaactaatatcacctctagagtataatataatcaaattcgacaatttgactttcaagagtaggctaatgtaaaatctttatatatttctacaatgttcaaagaaacagttgcatctaaacccctatggccatcaaattcaatgaacgctaagctgatccggcgagattttcaggagctaaggaagctaaaatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaattccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcaccatgggcaaatattatacgcaaggcgacaaggtgctgatgccgctggcgattcaggttcatcatgccgtctgtgatggcttccatgtcggcagaatgcttaatgaattacaacagtactgcgatgagtggcagggcggggcgtaaacgcgtggatcagcttaatatgactctcaataaagtctcataccaacaagtgccaccttattcaaccatcaagaaaaaagccaaaatttatgctactctaaggaaaacttcactaaagaagacgatttagagtgttttaccaagaatttctgtcatcttactaaacaactaaagatcggtgtgatacaaaacctaatctcattaaagtttatgctaaaataagcataattttacccactaagcgtgaccagataaacataactcagcacaccagagcatatatattggtggctcaaatcatagaaacttacagtgaagacacagaaagccgtaagaagaggcaagagtatgaaaccttacctcatcatttccatgaggttgcttctgatcccgcgggatatcaccactttgtacaagaaagctgggtcgaattcgcccttgcatggatgttggacaaattggggggtgtcttcgcccctcgtccatccaccgggcctcacaagttgcgcgaatccctgcctttagtgattttccttcgtaacaggctgaagtatgcccttacaaacagtgaagtcactaaaattgtcatgcaaaggttgatcaaagttgatggtaaagtgaggactgattctaattaccctgctggtttcatggatgtcattactattgagaagactggtgaatttttccgtctgatctatgatgttaaaggaagatttgctgtgcaccgtattacagctgaagaggcaaaatacaagttgtgtaaagtaaggagagtccaaactggtcccaaaggaatcccatttttggtaacacatgatggcagaaccattcgttaccctgaccccaacatcaaagtgaatgacacaattcaaatggaaattgctacatctaaaattcttgactacatcaaatttgaatct

SEQ ID NO: 509 - DNA, 4700 bp, Phaedon cochleariae
ctctcaaggattctttgcagatgtcgctcagcctattaccgcccaacgcgttgattggattgatcacgttcggaaaaatggtgcaagtccacgaactgggtaccgaaggctgcagcaagtcgtacgtgttctgtggaacgaaagatctcaccgccaagcaagtccaggagatgttgggcattggaaaagggtcaccaaatccccaacaacagccagggcaacctgggcggccagggcagaatccccaagctgcccctgtaccaccggggagcagattcttgcagcccgtgtcaaaatgcgacatgaacttgacagatctgatcggggagttgcagaaagacccttggcccgtacatcagggcaaaagacctcttagatccacaggcgcagcattgtccatcgctgtcggcctcttagaatgcacctatccgaatacgggtggcagaatcatgatattcttaggaggaccatgctctcagggtcccggccaggtgttgaacgacgatttgaagcagcccatcaggtcccatcatgacatacacaaagacaatgccaagtacatgaagaaggctatcaaacattacgatcacttggcaatgcgagctgccaccaacagccattgcatcgacatttactcctgcgccctggatcagacgggactgatggagatgaagcagtgctgcaattccaccggagggcacatggtcatgggcgattccttcaattcctctctattcaaacaaaccttccagcgagtgttctcaaaagacccgaagaacgacctcaagatggcgttcaacgccaccttggaggtgaagtgttccagggagttaaaagtccaagggggcatcggctcgtgcgtgtccttgaacgttaaaagccctctggtttccgatacggaactaggcatggggaatactgtgcagtggaaactttgcacgttggcgccgagctctactgtggcgctgttcttcgaggtggttaaccagcattcggcgcccataccacagggaggcaggggctgcatccagctcatcacccagtatcagcacgcgagcgggcaaaggaggatcagagtgaccacgattgctagaaattgggcggacgctactgccaacatccaccacattagcgctggcttcgaccaagaagcggcggcagttgtgatggcccgaatggccggttacaaggcggaatcggacgagactcccgacgtgctcagatgggtggacaggatgttgatcaggctgtgccagaagttcggagagtacaataaagacgatccgaattcgttcaggttgggggagaacttcagtctgtatccgcagttcatgtaccatttgagacggtcgcagtttctgcaggtgttcaataattctcctgatgaaacgtcgttttataggcacatgctgatgcgtgaggatttgactcagtctttgatcatgatccagccgattttgtacagttacagcttcaacgggccgcccgagcctgtgttgttggacacaagctctattcagccggatagaatcctgctcatggacactttcttccagatactcattttccatggagagaccattgcccaatggcgaagggcgaattcgacccagctttcttgtacaaagtggtgatatcactagtgcggccgcctgcaggtcgaccatatggtcgacctgcaggcggccgcactagtgatgctgttatgttcagtgtcaagctgacctgcaaacacgttaaatgctaagaagttagaatatatgagacacgttaactggtatatgaataagctgtaaataaccgagtataaactcattaactaatatcacctctagagtataatataatcaaattcgacaatttgactttcaagagtaggctaatgtaaaatctttatatatttctacaatgttcaaagaaacagttgcatctaaacccctatggccatcaaattcaatgaacgctaagctgatccggcgagattttcaggagctaaggaagctaaaatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaattccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcaccatgggcaaatattatacgcaaggcgacaaggtgctgatgccgctggcgattcaggttcatcatgccgtctgtgatggcttccatgtcggcagaatgcttaatgaattacaacagtactgcgatgagtggcagggcggggcgtaaacgcgtggatcagcttaatatgactctcaataaagtctcataccaacaagtgccaccttattcaaccatcaagaaaaaagccaaaatttatgctactctaaggaaaacttcactaaagaagacgatttagagtgttttaccaagaatttctgtcatcttactaaacaactaaagatcggtgtgatacaaaacctaatctcattaaagtttatgctaaaataagcataattttacccactaagcgtgaccagataaacataactcagcacaccagagcatatatattggtggctcaaatcatagaaacttacagtgaagacacagaaagccgtaagaagaggcaagagtatgaaaccttacctcatcatttccatgaggttgcttctgatcccgcgggatatcaccactttgtacaagaaagctgggtcgaattcgcccttcgccattgggcaatggtctctccatggaaaatgagtatctggaagaaagtgtccatgagcaggattctatccggctgaatagagcttgtgtccaacaacacaggctcgggcggcccgttgaagctgtaactgtacaaaatcggctggatcatgatcaaagactgagtcaaatcctcacgcatcagcatgtgcctataaaacgacgtttcatcaggagaattattgaacacctgcagaaactgcgaccgtctcaaatggtacatgaactgcggatacagactgaagttctcccccaacctgaacgaattcggatcgtctttattgtactctccgaacttctggcacagcctgatcaacatcctgtccacccatctgagcacgtcgggagtctcgtccgattccgccttgtaaccggccattcgggccatcacaactgccgccgcttcttggtcgaagccagcgctaatgtggtggatgttggcagtagcgtccgcccaatttctagcaatcgtggtcactctgatcctcctttgcccgctcgcgtgctgatactgggtgatgagctggatgcagcccctgcctccctgtggtatgggcgccgaatgctggttaaccacctcgaagaacagcgccacagtagagctcggcgccaacgtgcaaagtttccactgcacagtattccccatgcctagttccgtatcggaaaccagagggcttttaacgttcaaggacacgcacgagccgatgcccccttggacttttaactccctggaacacttcacctccaaggtggcgttgaacgccatcttgaggtcgttcttcgggtcttttgagaacactcgctggaaggtttgtttgaatagagaggaattgaaggaatcgcccatgaccatgtgccctccggtggaattgcagcactgcttcatctccatcagtcccgtctgatccagggcgcaggagtaaatgtcgatgcaatggctgttggtggcagctcgcattgccaagtgatcgtaatgtttgatagccttcttcatgtacttggcattgtctttgtgtatgtcatgatgggacctgatgggctgcttcaaatcgtcgttcaacacctggccgggaccctgagagcatggtcctcctaagaatatcatgattctgccacccgtattcggataggtgcattctaagaggccgacagcgatggacaatgctgcgcctgtggatctaagaggtcttttgccctgatgtacgggccaagggtctttctgcaactccccgatcagatctgtcaagttcatgtcgcattttgacacgggctgcaagaatctgctccccggtggtacaggggcagcttggggattctgccctggccgcccaggttgccctggctgttgttggggatttggtgacccttttccaatgcccaacatctcctggacttgcttggcggtgagatctttcgttccacagaacacgtacgacttgctgcagccttcggtacccagttcgtggacttgcaccatttttccgaacgtgatcaatccaatcaacgcgttgggcggtaataggctgagcgacatctgcaaagaatccttgagag

SEQ ID NO: 510 - DNA, 2726 bp, Phaedon cochleariae
cgcagatcaaacatatgatggctttcattgaacaagaagccaatgagaaagcagaagaaatcgatgccaaggcagaggaggaattcaacattgaaaaagggcgtttagtccagcaacagagactcaagatcatggagtactacgagaaaaaggagaagcaagtcgaacttcaaaagaaaattcagtcctctaatatgttgaatcaggctcgtttgaaggtgctgaaagtgagagaggaccatgtcagagcagtcctggaggatgctcgtaaaagtcttggtgaagtaaccaaagaccaaggaaaatactcccaaattttggagagcctaatcctacaaggactgttccagctgttcgagaaggaggtgacggtccgcgtgagaccgcaagatagggacttggttaggtccatcctgcccaacgtcgctgccaaatacaaggacgccaccggcaaagacatcctactcaaggtggacgatgagtcgcacctgtctcaggagatcaccggaggcgtcgatctgctcgctcagaagaacaagatcaagatcagcaacacgatggaggctaggttggatctgatcgctcagcaattggtgcccgagatccgaagggcgaattcgacccagctttcttgtacaaagtggtgatatcactagtgcggccgcctgcaggtcgaccatatggtcgacctgcaggcggccgcactagtgatgctgttatgttcagtgtcaagctgacctgcaaacacgttaaatgctaagaagttagaatatatgagacacgttaactggtatatgaataagctgtaaataaccgagtataaactcattaactaatatcacctctagagtataatataatcaaattcgacaatttgactttcaagagtaggctaatgtaaaatctttatatatttctacaatgttcaaagaaacagttgcatctaaacccctatggccatcaaattcaatgaacgctaagctgatccggcgagattttcaggagctaaggaagctaaaatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaattccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcaccatgggcaaatattatacgcaaggcgacaaggtgctgatgccgctggcgattcaggttcatcatgccgtctgtgatggcttccatgtcggcagaatgcttaatgaattacaacagtactgcgatgagtggcagggcggggcgtaaacgcgtggatcagcttaatatgactctcaataaagtctcataccaacaagtgccaccttattcaaccatcaagaaaaaagccaaaatttatgctactctaaggaaaacttcactaaagaagacgatttagagtgttttaccaagaatttctgtcatcttactaaacaactaaagatcggtgtgatacaaaacctaatctcattaaagtttatgctaaaataagcataattttacccactaagcgtgaccagataaacataactcagcacaccagagcatatatattggtggctcaaatcatagaaacttacagtgaagacacagaaagccgtaagaagaggcaagagtatgaaaccttacctcatcatttccatgaggttgcttctgatcccgcgggatatcaccactttgtacaagaaagctgggtcgaattcgcccttcggatctcgggcaccaattgctgagcgatcagatccaacctagcctccatcgtgttgctgatcttgatcttgttcttctgagcgagcagatcgacgcctccggtgatctcctgagacaggtgcgactcatcgtccaccttgagtaggatgtctttgccggtggcgtccttgtatttggcagcgacgttgggcaggatggacctaaccaagtccctatcttgcggtctcacgcggaccgtcacctccttctcgaacagctggaacagtccttgtaggattaggctctccaaaatttgggagtattttccttggtctttggttacttcaccaagacttttacgagcatcctccaggactgctctgacatggtcctctctcactttcagcaccttcaaacgagcctgattcaacatattagaggactgaattttcttttgaagttcgacttgcttctcctttttctcgtagtactccatgatcttgagtctctgttgctggactaaacgccctttttcaatgttgaattcctcctctgccttggcatcgatttcttctgctttctcattggcttcttgttcaatgaaagccatcatatgtttgatctgcg

SEQ ID NO: 511 - DNA, 3330 bp, Phaedon cochleariae
ttgggcatagtcaagatggggatctgcgtgatggagccgttgcggccctccacacgaccggcgcgctcgtaaatggtggccagatcggtgtacatgtaaccggggaaacccctacggccgggcacttcttctcgagcggcagacacctcacgcaacgcctccgcgtacgacgacatgtcggtcaagatgaccagcacgtgcttctcgcactggtaggccaagaattcggcggccgtcagagccaaacgcggcgtgatgatgcgctcgatggtcggatcgttggccaagttcaagaacagacacacgttctccatcgagccgttctcttcgaagtcctgcttgaagaacctggcagtttccatgttgacacccatagcagcaaacacaatagcaaagttgtcttcatggtcatccagcacagacttgccaggtactttgaccaagccagcctgcctacaaatctgggctgcaatctcattgtggggcagcccagcggcggagaagatcggaatcttctgccctctggcgatagagttcatcacgtcgatggccgtgatcccagtctggatcatttcctcgggataaatacgcgaccacgggttgatcggctgtccttggatgtcgaggtagtcctcagccaggatcgggggacctttatcaatgggttttcctgatccattgaagacacgtcccagcatatcttctgatactggagttcttagaatatctccagtgaactcacacaccgtgttcttagcatcaatacctgatgtgccttcaaatacctgaacaactgcctttgatccactgacttccaaaacttgtccagatcgtagagttccatctgccaatttgagctggacaatttcattgaattttggaaacttgacatcctcaagaatgaccagtaagggcgaattcgacccagctttcttgtacaaagtggtgatatcactagtgcggccgcctgcaggtcgaccatatggtcgacctgcaggcggccgcactagtgatgctgttatgttcagtgtcaagctgacctgcaaacacgttaaatgctaagaagttagaatatatgagacacgttaactggtatatgaataagctgtaaataaccgagtataaactcattaactaatatcacctctagagtataatataatcaaattcgacaatttgactttcaagagtaggctaatgtaaaatctttatatatttctacaatgttcaaagaaacagttgcatctaaacccctatggccatcaaattcaatgaacgctaagctgatccggcgagattttcaggagctaaggaagctaaaatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaattccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcaccatgggcaaatattatacgcaaggcgacaaggtgctgatgccgctggcgattcaggttcatcatgccgtctgtgatggcttccatgtcggcagaatgcttaatgaattacaacagtactgcgatgagtggcagggcggggcgtaaacgcgtggatcagcttaatatgactctcaataaagtctcataccaacaagtgccaccttattcaaccatcaagaaaaaagccaaaatttatgctactctaaggaaaacttcactaaagaagacgatttagagtgttttaccaagaatttctgtcatcttactaaacaactaaagatcggtgtgatacaaaacctaatctcattaaagtttatgctaaaataagcataattttacccactaagcgtgaccagataaacataactcagcacaccagagcatatatattggtggctcaaatcatagaaacttacagtgaagacacagaaagccgtaagaagaggcaagagtatgaaaccttacctcatcatttccatgaggttgcttctgatcccgcgggatatcaccactttgtacaagaaagctgggtcgaattcgcccttactggtcattcttgaggatgtcaagtttccaaaattcaatgaaattgtccagctcaaattggcagatggaactctacgatctggacaagttttggaagtcagtggatcaaaggcagttgttcaggtatttgaaggcacatcaggtattgatgctaagaacacggtgtgtgagttcactggagatattctaagaactccagtatcagaagatatgctgggacgtgtcttcaatggatcaggaaaacccattgataaaggtcccccgatcctggctgaggactacctcgacatccaaggacagccgatcaacccgtggtcgcgtatttatcccgaggaaatgatccagactgggatcacggccatcgacgtgatgaactctatcgccagagggcagaagattccgatcttctccgccgctgggctgccccacaatgagattgcagcccagatttgtaggcaggctggcttggtcaaagtacctggcaagtctgtgctggatgaccatgaagacaactttgctattgtgtttgctgctatgggtgtcaacatggaaactgccaggttcttcaagcaggacttcgaagagaacggctcgatggagaacgtgtgtctgttcttgaacttggccaacgatccgaccatcgagcgcatcatcacgccgcgtttggctctgacggccgccgaattcttggcctaccagtgcgagaagcacgtgctggtcatcttgaccgacatgtcgtcgtacgcggaggcgttgcgtgaggtgtctgccgctcgagaagaagtgcccggccgtaggggtttccccggttacatgtacaccgatctggccaccatttacgagcgcgccggtcgtgtggagggccgcaacggctccatcacgcagatccccatcttgactatgcccaa

SEQ ID NO: 512 - DNA, 3356 bp, Phaedon cochleariae
gggccaagcacagcgaaatgcagcaagctaacttgaaagcactaccagaaggagctgaaatcagagatggagaacgtttgccagtcacagtaaaggacatgggagcatgcgagatttacccacaaacaatccaacacaaccccaatgggcggtttgtagtggtttgtggtgatggagaatacataatatacacggctatggcccttcgtaacaaagcatttggtagcgctcaagaatttgtatgggcacaggactccagtgaatatgccatccgcgaatccggatccaccattcgaatcttcaagaatttcaaagaaaaaaagaatttcaagtccgactttggtgccgaaggaatctatggtggttttctcttgggtgtgaaatcagtgtctggcttagctttctatgactgggaaacgcttgagttagtaaggcgcattgaaatacagcctagagctatctactggtcagatagtggcaagttggtatgccttgctaccgaagatagctatttcatattgtcctatgactctgaccaagtccagaaagctagagataacaaccaagttgccgaagatggagtggaggctgcctttgatgtcctaggtgaaataaatgaatccgtaagaacaggtctttgggtaggagactgcttcatttacacaaacgcagtcaaccgtatcaactactttgtgggtggtgaattggtaactattgcacatctggaccgtcctctatatgtcctgggctatgtacctagagatgacaggttatacttggttgataaagagttaggagtagtcagctatcaattgctattatctgtactcgaatatcagactgcagtcatgcgacgagacttcccaacggctgatcgagtattgccttcaattccaaaagaacaccgcactagggtggcacaaagggcgaattcgacccagctttcttgtacaaagtggtgatatcactagtgcggccgcctgcaggtcgaccatatggtcgacctgcaggcggccgcactagtgatgctgttatgttcagtgtcaagctgacctgcaaacacgttaaatgctaagaagttagaatatatgagacacgttaactggtatatgaataagctgtaaataaccgagtataaactcattaactaatatcacctctagagtataatataatcaaattcgacaatttgactttcaagagtaggctaatgtaaaatctttatatatttctacaatgttcaaagaaacagttgcatctaaacccctatggccatcaaattcaatgaacgctaagctgatccggcgagattttcaggagctaaggaagctaaaatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaattccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcaccatgggcaaatattatacgcaaggcgacaaggtgctgatgccgctggcgattcaggttcatcatgccgtctgtgatggcttccatgtcggcagaatgcttaatgaattacaacagtactgcgatgagtggcagggcggggcgtaaacgcgtggatcagcttaatatgactctcaataaagtctcataccaacaagtgccaccttattcaaccatcaagaaaaaagccaaaatttatgctactctaaggaaaacttcactaaagaagacgatttagagtgttttaccaagaatttctgtcatcttactaaacaactaaagatcggtgtgatacaaaacctaatctcattaaagtttatgctaaaataagcataattttacccactaagcgtgaccagataaacataactcagcacaccagagcatatatattggtggctcaaatcatagaaacttacagtgaagacacagaaagccgtaagaagaggcaagagtatgaaaccttacctcatcatttccatgaggttgcttctgatcccgcgggatatcaccactttgtacaagaaagctgggtcgaattcgccctttgtgccaccctagtgcggtgttcttttggaattgaaggcaatactcgatcagccgttgggaagtctcgtcgcatgactgcagtctgatattcgagtacagataatagcaattgatagctgactactcctaactctttatcaaccaagtataacctgtcatctctaggtacatagcccaggacatatagaggacggtccagatgtgcaatagttaccaattcaccacccacaaagtagttgatacggttgactgcgtttgtgtaaatgaagcagtctcctacccaaagacctgttcttacggattcatttatttcacctaggacatcaaaggcagcctccactccatcttcggcaacttggttgttatctctagctttctggacttggtcagagtcataggacaatatgaaatagctatcttcggtagcaaggcataccaacttgccactatctgaccagtagatagctctaggctgtatttcaatgcgccttactaactcaagcgtttcccagtcatagaaagctaagccagacactgatttcacacccaagagaaaaccaccatagattccttcggcaccaaagtcggacttgaaattctttttttctttgaaattcttgaagattcgaatggtggatccggattcgcggatggcatattcactggagtcctgtgcccatacaaattcttgagcgctaccaaatgctttgttacgaagggccatagccgtgtatattatgtattctccatcaccacaaaccactacaaaccgcccattggggttgtgttggattgtttgtgggtaaatctcgcatgctcccatgtcctttactgtgactggcaaacgttctccatctctgatttcagctccttctggtagtgctttcaagttagcttgctgcatttcgctgtgcttggccc

SEQ ID NO: 513 - DNA, 505 bp, Epilachna varivetis
tgcgatgcggcaagaagaaggtttggctggatcctaatgaaataactgaaattgctaatacaaactctagacaaaacatccgcaaactgattaaagatggtcttattattaaaaagcctgtcgcggtgcattctcgtgcacgtgtacgcaaaaatactgaagcccgcaggaaaggtcgtcattgtggatttggtaaaaggaaaggaactgcaaatgctaggatgcccagaaaggaattatggattcaacgtatgagagttctcagaaggttattgaagaaatatagggaagctaagaaaattgataggcatttataccatgctttatatatgaaagctaagggaaatgtattcaagaataagagagtaatgatggactatatccataaaaagaaggcggagaaagcacgtacaaagatgctcaatgatcaagctgatgcaaggaggctgaaagtcaaagaggcacgtaagcgacgtgaagagcgtatcgctacgaagaagcagga

SEQ ID NO: 514 - protein, 167 aa, Epilachna varivetis
RCGKKKVWLDPNEITEIANTNSRQNIRKLIKDGLIIKKPVAVHSRARVRKNTEARRKGRHCGFGKRKGTANARMPRKELWIQRMRVLRRLLKKYREAKKIDRHLYHALYMKAKGNVFKNKRVMMDYIHKKKAEKARTKMLNDQADARRLKVKEARKRREERIATKKQ

SEQ ID NO: 515 - DNA, 683 bp, Epilachna varivetis
ccaactctcgatccaagcattccaaaatacaggactgaagaatctataataggaacaaacccaggaatgggttttaggccaatgcccgacaacaacgaagaaagtaccctgatttggttacagggttctaataaaacaaactacgaaaaatggaaaatgaatctcctctcatatttagacaagtattacactcccggaaaaatagaaaagggaaatattccagtaaagcgctgttcatacggagaaaaattgattaggggacaagtatgtgatgtagatgtgaggaaatgggagccgtgcaccccggaaaatcattttgattacctcagaaatgcgccttgtatatttctgaagctgaacaggatatatggatgggaaccggagtactacaacgatccaaatgatcttccagatgatatgccgcagcagttgaaggaccatatacgttataatatcaccaatccagtggagagaaataccgtctgggtaacatgcgcaggtgaaaatccggcagacgtggagtacttgggccctgtgaagtattacccatctttccagggattccccggttactattttccatatttgaattctgaagggtacctaagtccattattggcggtacaattcaagagaccggtgtctggtattgttataaatatcgagtgcaaagcgtgggctgc

SEQ ID NO: 516 - protein, 227 aa, Epilachna varivetis
PTLDPSIPKYRTEESIIGTNPGMGFRPMPDNNEESTLIWLQGSNKTNYEKWKMNLLSYLDKYYTPGKIEKGNIPVKRCSYGEKLIRGQVCDVDVRKWEPCTPENHFDYLRNAPCIFLKLNRIYGWEPEYYNDPNDLPDDMPQQLKDHIRYNITNPVERNTVWVTCAGENPADVEYLGPVKYYPSFQGFPGYYFPYLNSEGYLSPLLAVQFKRPVSGIVINIECKAWA

SEQ ID NO: 517 - DNA, 743 bp, Epilachna varivetis
ctggcggccacatggtcatgggtgattcatttaactcttcacttttcaaacaaacatttcaacgagtattttcgaaagattccaatggagacttgaagatgtccttcaacgccatattagaagtgaagtgttctagagaacttaaagtacaaggaggtataggtccttgtgtctctctaaatgtcaaaaatcctcttgtttctgatttagaaataggcatgggtaacacagttcagtggaaactgtgtagcttaagtccaagcactacggttgccttatttttcgaagttgttaatcagcatgcagcacccattcctcaagggggacgtggatgcattcagtttattactcaatatcagcattcaagtggtcagaaaaaaataagggtaactacaatagcaagaaattgggcggatgccactgcaaatattcaccatattagcgctggctttgacgaacaaactgcggctgttttaatggcgaggatcgctgtatatagagcagaaactgatgagagttcagatgttctcagatgggttgacagaatgttgatacgattgtgtcagaaatttggagaatataacaaagatgacaccaacagcttcaggctcagtgaaaacttcagcttatatccacagtttatgtatcatctacgtcgttcccaatttctacaagtgttcaataattcaccagatgaaacttcattctataggcacatgttgatgagggaagatcgcaatcag

SEQ ID NO: 518 - protein, 247 aa, Epilachna varivetis
GGHMVMGDSFNSSLFKQTFQRVFSKDSNGDLKMSFNAILEVKCSRELKVQGGIGPCVSLNVKNPLVSDLEIGMGNTVQWKLCSLSPSTTVALFFEVVNQHAAPIPQGGRGCIQFITQYQHSSGQKKIRVTTIARNWADATANIHHISAGFDEQTAAVLMARIAVYRAETDESSDVLRWVDRMLIRLCQKFGEYNKDDTNSFRLSENFSLYPQFMYHLRRSQFLQVFNNSPDETSFYRHMLMREDRNQ

SEQ ID NO: 519 - DNA, 734 bp, Epilachna varivetis
cgccatccgtcgctgttcaaggcgatcggcgttaagcctccaaggggtattctcctttacgggcctcccggcacggggaaaacgctgatcgccagggccgttgccaacgaaactggtgcgttcttcttcctcatcaatgggcccgagattatgagcaagctggccggagaatccgagagcaatcttagaaaggcttttgaagaggctgataaaaactctcctgcaatcatctttatcgacgaattagacgcaatcgctcccaagcgcgagaagactcatggtgaggtagagagacgcatcgtctcccaactgttgactttgatggacggcatgaagaaaagttcccatgtgatcgtgatggcggccacgaacaggcccaattccatcgaccctgcactcagacgtttcggccgattcgacagagagatcgacatcggtatccccgacgctactggaagattagaagtactcagaatacacaccaaaaacatgaaattggctgacgatgtagatttggaacagattgccgcagagactcacggtcatgtaggtgctgacttggcttctttgtgctcagaggctgccttgcaacaaattagagaaaaaatggacctcatcgacttagatgatgagcagatcgatgccgaagtcctaaattctctggcagttaccatggagaacttccgttacgccatgtctaagagcagtccgagcgctttgcgcgaaaccgtcgt

SEQ ID NO: 520 - protein, 244 aa, Epilachna varivetis
RHPSLFKAIGVKPPRGILLYGPPGTGKTLIARAVANETGAFFFLINGPEIMSKLAGESESNLRKAFEEADKNSPAIIFIDELDAIAPKREKTHGEVERRIVSQLLTLMDGMKKSSHVIVMAATNRPNSIDPALRRFGRFDREIDIGIPDATGRLEVLRIHTKNMKLADDVDLEQIAAETHGHVGADLASLCSEAALQQIREKMDLIDLDDEQIDAEVLNSLAVTMENFRYAMSKSSPSALRETV

SEQ ID NO: 521 - DNA, 799 bp, Epilachna varivetis
gactgtgtctggtgtgaacggaccgttggtgatccttgatagtgttaagtttccaaaatttaacgaaattgtacagctcaagttatcagatggaacagttaggtctggacaagttttggaagtcagtggacagaaggcggttgtccaagtttttgaaggcacctccggaattgatgctaaaaacactttatgtgaatttacaggagatatcttaagaactccagtgtctgaagatatgttgggtcgtgtgtttaatggatctggaaagcctatcgataaagggccgccaatcttagctgaagattttcttgacattcaaggtcaacctataaatccttggtctcgtatctatccagaagaaatgatccagactggtatttctgcgattgatgtgatgaattccattgccagaggacaaaagattccaattttctctgcagctggtttaccccacaatgaaatcgctgctcaaatctgtagacaagctggtcttgtcaaaatcccagggaaatctgtcttagatgatcatgaagacaactttgctatcgttttcgccgctatgggtgtcaatatggaaacagccagattcttcaagcaagattttgaagagaatggctctatggaaaatgtgtgcctatttttgaacttggccaatgatcctaccattgaaagaattataacaccccgtttgactttaacagcggctgaatttatggcatatcaatgtgagaagcatgtgttagtcatattgactgacatgtcatcttatgctgaggctttgcgtgaggtatctgctgct

SEQ ID NO: 522 - protein, 266 aa, Epilachna varivetis
TVSGVNGPLVILDSVKFPKFNEIVQLKLSDGTVRSGQVLEVSGQKAVVQVFEGTSGIDAKNTLCEFTGDILRTPVSEDMLGRVFNGSGKPIDKGPPILAEDFLDIQGQPINPWSRIYPEEMIQTGISAIDVMNSIARGQKIPIFSAAGLPHNEIAAQICRQAGLVKIPGKSVLDDHEDNFAIVFAAMGVNMETARFFKQDFEENGSMENVCLFLNLANDPTIERIITPRLTLTAAEFMAYQCEKHVLVILTDMSSYAEALREVSAA

SEQ ID NO: 523 - DNA, 26 bp, Artificial Sequence
  synthetic oligo
tgcgatgcggcaaraaraaggtbtgg

SEQ ID NO: 524 - DNA, 26 bp, Artificial Sequence
  synthetic oligo
tcctgcttcttsgyrgcratwcgytc

SEQ ID NO: 525 - DNA, 25 bp, Artificial Sequence
  synthetic oligo
gggccgtggtcagaayatywayaac

SEQ ID NO: 526 - DNA, 20 bp, Artificial Sequence
  synthetic oligo
gcagcccacgcyytgcactc

SEQ ID NO: 527 - DNA, 23 bp, Artificial Sequence
  synthetic oligo
cggctgacgtggaaygtktggcc

SEQ ID NO: 528 - DNA, 24 bp, Artificial Sequence
  synthetic oligo
cggcgtattctccraayttctggc

SEQ ID NO: 529 - DNA, 21 bp, Artificial Sequence
  synthetic oligo
cgctgtcgcargcraaratgg

SEQ ID NO: 530 - DNA, 23 bp, Artificial Sequence
  synthetic oligo
cgatcaaagcgwccraavcgacg

SEQ ID NO: 531 - DNA, 21 bp, Artificial Sequence
  synthetic oligo
gttcaccggcgayatyctgcg

SEQ ID NO: 532 - DNA, 24 bp, Artificial Sequence
  synthetic oligo
cggcatagtcagaatsggratctg

SEQ ID NO: 533 - DNA, 23 bp, Epilachna varivetis
aagcgacgtgaagagcgtatcgc

SEQ ID NO: 534 - DNA, 23 bp, Epilachna varivetis
attaaagatggtcttattattaa

SEQ ID NO: 535 - DNA, 26 bp, Epilachna varivetis
cgtaagcgacgtgaagagcgtatcgc

SEQ ID NO: 536 - DNA, 26 bp, Epilachna varivetis
ggtcgtcattgtggatttggtaaaag

SEQ ID NO: 537 - DNA, 22 bp, Epilachna varivetis
tgcgatgcggcaagaagaaggt

SEQ ID NO: 538 - DNA, 21 bp, Epilachna varivetis
tgcggcaagaagaaggtttgg

SEQ ID NO: 539 - DNA, 21 bp, Epilachna varivetis
ttgtggatttggtaaaaggaa

SEQ ID NO: 540 - DNA, 21 bp, Epilachna varivetis
caagtgttcaataattcacca

SEQ ID NO: 541 - DNA, 23 bp, Epilachna varivetis
cattctataggcacatgttgatg

SEQ ID NO: 542 - DNA, 22 bp, Epilachna varivetis
ctggcggccacatggtcatggg

SEQ ID NO: 543 - DNA, 23 bp, Epilachna varivetis
aacaggcccaattccatcgaccc

SEQ ID NO: 544 - DNA, 24 bp, Epilachna varivetis
agagaaaaaatggacctcatcgac

SEQ ID NO: 545 - DNA, 29 bp, Epilachna varivetis
cgccatccgtcgctgttcaaggcgatcgg

SEQ ID NO: 546 - DNA, 36 bp, Epilachna varivetis
ctggcagttaccatggagaacttccgttacgccatg

SEQ ID NO: 547 - DNA, 23 bp, Epilachna varivetis
gtgatcgtgatggcggccacgaa

SEQ ID NO: 548 - DNA, 24 bp, Epilachna varivetis
gtgatcgtgatggcggccacgaac

SEQ ID NO: 549 - DNA, 22 bp, Epilachna varivetis
tgatggacggcatgaagaaaag

SEQ ID NO: 550 - DNA, 23 bp, Epilachna varivetis
aatatggaaacagccagattctt

SEQ ID NO: 551 - DNA, 23 bp, Epilachna varivetis
atgatccagactggtatttctgc

SEQ ID NO: 552 - DNA, 24 bp, Epilachna varivetis
attgatgtgatgaattccattgcc

SEQ ID NO: 553 - DNA, 26 bp, Epilachna varivetis
gaaatgatccagactggtatttctgc

SEQ ID NO: 554 - DNA, 23 bp, Epilachna varivetis
gaagaaatgatccagactggtat

SEQ ID NO: 555 - DNA, 21 bp, Epilachna varivetis
gactgtgtctggtgtgaacgg

SEQ ID NO: 556 - DNA, 23 bp, Epilachna varivetis
gatatgttgggtcgtgtgtttaa

SEQ ID NO: 557 - DNA, 23 bp, Epilachna varivetis
gatcctaccattgaaagaattat

SEQ ID NO: 558 - DNA, 26 bp, Epilachna varivetis
gtgtctgaagatatgttgggtcgtgt

SEQ ID NO: 559 - DNA, 21 bp, Epilachna varivetis
gtgtctggtgtgaacggaccg

SEQ ID NO: 560 - DNA, 23 bp, Epilachna varivetis
tctgaagatatgttgggtcgtgt

SEQ ID NO: 561 - DNA, 22 bp, Epilachna varivetis
tggcatatcaatgtgagaagca

SEQ ID NO: 562 - DNA, 26 bp, Epilachna varivetis
ttgaacttggccaatgatcctaccat

SEQ ID NO: 563 - DNA, 22 bp, Epilachna varivetis
ttaaagatggtcttattattaa

SEQ ID NO: 564 - DNA, 23 bp, Artificial Sequence
  synthetic oligo
gctatgggtgtcaatatggaaac

SEQ ID NO: 565 - DNA, 23 bp, Artificial Sequence
  synthetic oligo
ttcaataattcaccagatgaaac

SEQ ID NO: 566 - DNA, 21 bp, Artificial Sequence
  synthetic oligo
cgatcgccttgaacagcgacg

SEQ ID NO: 567 - DNA, 23 bp, Artificial Sequence
  synthetic oligo
gttaccatggagaacttccgtta

SEQ ID NO: 568 - DNA, 27 bp, Artificial Sequence
  synthetic oligo
gttaccatggagaacttccgttacgcc

SEQ ID NO: 569 - DNA, 24 bp, Artificial Sequence
  synthetic oligo
accatggagaacttccgttacgcc

SEQ ID NO: 570 - DNA, 21 bp, Artificial Sequence
  synthetic oligo
atggagaacttccgttacgcc

SEQ ID NO: 571 - DNA, 23 bp, Artificial Sequence
  synthetic oligo
tctgaagatatgttgggtcgtgt

SEQ ID NO: 572 - DNA, 24 bp, Artificial Sequence
  synthetic oligo
caaaagattccaattttctctgca

SEQ ID NO: 573 - DNA, 26 bp, Artificial Sequence
  synthetic oligo
ccccacaatgaaatcgctgctcaaat

SEQ ID NO: 574 - DNA, 23 bp, Artificial Sequence
  synthetic oligo
atcgttttcgccgctatgggtgt

SEQ ID NO: 575 - DNA, 26 bp, Artificial Sequence
  synthetic oligo
ttcaagcaagattttgaagagaatgg

SEQ ID NO: 576 - DNA, 376 bp, Epilachna varivetis
gacaaaacatccgcaaactgattaaagatggtcttattattaaaaagcctgtcgcggtgcattctcgtgcacgtgtacgcaaaaatactgaagcccgcaggaaaggtcgtcattgtggatttggtaaaaggaaaggaactgcaaatgctaggatgcccagaaaggaattatggattcaacgtatgagagttctcagaaggttattgaagaaatatagggaagctaagaaaattgataggcatttataccatgctttatatatgaaagctaagggaaatgtattcaagaataagagagtaatgatggactatatccataaaaagaaggcggagaaagcacgtacaaagatgctcaatgatcaagctgatgcaaggag

SEQ ID NO: 577 - DNA, 20 bp, Artificial Sequence
  synthetic oligo
gacaaaacatccgcaaactg

SEQ ID NO: 578 - DNA, 42 bp, Artificial Sequence
  synthetic oligo
gcgtaatacgactcactataggctccttgcatcagcttgatc

SEQ ID NO: 579 - DNA, 42 bp, Artificial Sequence
  synthetic oligo
gcgtaatacgactcactatagggacaaaacatccgcaaactg

SEQ ID NO: 580 - DNA, 20 bp, Artificial Sequence
  synthetic oligo
ctccttgcatcagcttgatc

SEQ ID NO: 581 - DNA, 529 bp, Epilachna varivetis
caggactgaagaatctataataggaacaaacccaggaatgggttttaggccaatgcccgacaacaacgaagaaagtaccctgatttggttacagggttctaataaaacaaactacgaaaaatggaaaatgaatctcctctcatatttagacaagtattacactcccggaaaaatagaaaagggaaatattccagtaaagcgctgttcatacggagaaaaattgattaggggacaagtatgtgatgtagatgtgaggaaatgggagccgtgcaccccggaaaatcattttgattacctcagaaatgcgccttgtatatttctgaagctgaacaggatatatggatgggaaccggagtactacaacgatccaaatgatcttccagatgatatgccgcagcagttgaaggaccatatacgttataatatcaccaatccagtggagagaaataccgtctgggtaacatgcgcaggtgaaaatccggcagacgtggagtacttgggccctgtgaagtattacccatctttccag

SEQ ID NO: 582 - DNA, 24 bp, Artificial Sequence
  synthetic oligo
caggactgaagaatctataatagg

SEQ ID NO: 583 - DNA, 44 bp, Artificial Sequence
  synthetic oligo
gcgtaatacgactcactataggctggaaagatgggtaatacttc

SEQ ID NO: 584 - DNA, 46 bp, Artificial Sequence
  synthetic oligo
gcgtaatacgactcactataggcaggactgaagaatctataatagg

SEQ ID NO: 585 - DNA, 22 bp, Artificial Sequence
  synthetic oligo
ctggaaagatgggtaatacttc

SEQ ID NO: 586 - DNA, 651 bp, Epilachna varivetis
ccaatggagacttgaagatgtccttcaacgccatattagaagtgaagtgttctagagaacttaaagtacaaggaggtataggtccttgtgtctctctaaatgtcaaaaatcctcttgtttctgatttagaaataggcatgggtaacacagttcagtggaaactgtgtagcttaagtccaagcactacggttgccttatttttcgaagttgttaatcagcatgcagcacccattcctcaagggggacgtggatgcattcagtttattactcaatatcagcattcaagtggtcagaaaaaaataagggtaactacaatagcaagaaattgggcggatgccactgcaaatattcaccatattagcgctggctttgacgaacaaactgcggctgttttaatggcgaggatcgctgtatatagagcagaaactgatgagagttcagatgttctcagatgggttgacagaatgttgatacgattgtgtcagaaatttggagaatataacaaagatgacaccaacagcttcaggctcagtgaaaacttcagcttatatccacagtttatgtatcatctacgtcgttcccaatttctacaagtgttcaataattcaccagatgaaacttcattctataggcacatgttgatgagggaag

SEQ ID NO: 587 - DNA, 22 bp, Artificial Sequence
  synthetic oligo
ccaatggagacttgaagatgtc

SEQ ID NO: 588 - DNA, 42 bp, Artificial Sequence
  synthetic oligo
gcgtaatacgactcactataggcttccctcatcaacatgtgc

SEQ ID NO: 589 - DNA, 44 bp, Artificial Sequence
  synthetic oligo
gcgtaatacgactcactataggccaatggagacttgaagatgtc

SEQ ID NO: 590 - DNA, 20 bp, Artificial Sequence
  synthetic oligo
cttccctcatcaacatgtgc

SEQ ID NO: 591 - DNA, 545 bp, Epilachna varivetis
gttaagcctccaaggggtattctcctttacgggcctcccggcacggggaaaacgctgatcgccagggccgttgccaacgaaactggtgcgttcttcttcctcatcaatgggcccgagattatgagcaagctggccggagaatccgagagcaatcttagaaaggcttttgaagaggctgataaaaactctcctgcaatcatctttatcgacgaattagacgcaatcgctcccaagcgcgagaagactcatggtgaggtagagagacgcatcgtctcccaactgttgactttgatggacggcatgaagaaaagttcccatgtgatcgtgatggcggccacgaacaggcccaattccatcgaccctgcactcagacgtttcggccgattcgacagagagatcgacatcggtatccccgacgctactggaagattagaagtactcagaatacacaccaaaaacatgaaattggctgacgatgtagatttggaacagattgccgcagagactcacggtcatgtaggtgctgacttggcttctttgtgctc

SEQ ID NO: 592 - DNA, 22 bp, Artificial Sequence
  synthetic oligo
gttaagcctccaaggggtattc

SEQ ID NO: 593 - DNA, 44 bp, Artificial Sequence
  synthetic oligo
gcgtaatacgactcactatagggagcacaaagaagccaagtcag

SEQ ID NO: 594 - DNA, 44 bp, Artificial Sequence
  synthetic oligo
gcgtaatacgactcactatagggttaagcctccaaggggtattc

SEQ ID NO: 595 - DNA, 22 bp, Artificial Sequence
  synthetic oligo
gagcacaaagaagccaagtcag

SEQ ID NO: 596 - DNA, 749 bp, Epilachna varivetis
ggtgatccttgatagtgttaagtttccaaaatttaacgaaattgtacagctcaagttatcagatggaacagttaggtctggacaagttttggaagtcagtggacagaaggcggttgtccaagtttttgaaggcacctccggaattgatgctaaaaacactttatgtgaatttacaggagatatcttaagaactccagtgtctgaagatatgttgggtcgtgtgtttaatggatctggaaagcctatcgataaagggccgccaatcttagctgaagattttcttgacattcaaggtcaacctataaatccttggtctcgtatctatccagaagaaatgatccagactggtatttctgcgattgatgtgatgaattccattgccagaggacaaaagattccaattttctctgcagctggtttaccccacaatgaaatcgctgctcaaatctgtagacaagctggtcttgtcaaaatcccagggaaatctgtcttagatgatcatgaagacaactttgctatcgttttcgccgctatgggtgtcaatatggaaacagccagattcttcaagcaagattttgaagagaatggctctatggaaaatgtgtgcctatttttgaacttggccaatgatcctaccattgaaagaattataacaccccgtttgactttaacagcggctgaatttatggcatatcaatgtgagaagcatgtgttagtcatattgactgacatgtcatcttatgctgagg

SEQ ID NO: 597 - DNA, 22 bp, Artificial Sequence
  synthetic oligo
ggtgatccttgatagtgttaag

SEQ ID NO: 598 - DNA, 42 bp, Artificial Sequence
  synthetic oligo
gcgtaatacgactcactataggcctcagcataagatgacatg

SEQ ID NO: 599 - DNA, 44 bp, Artificial Sequence
  synthetic oligo
gcgtaatacgactcactataggggtgatccttgatagtgttaag

SEQ ID NO: 600 - DNA, 20 bp, Artificial Sequence
  synthetic oligo
cctcagcataagatgacatg

SEQ ID NO: 601 - DNA, 727 bp, Anthonomus grandis
catttgaagcgttttgctgcccccaaagcatggatgttggacaaattggggggtgtgttcgcccccaggccctccaccgggccacacaagctcagggagtcccttccattagtgattttcttgcgtaacaggttgaagtacgccctgacaaactgtgaggtgaccaagatcgttatgcagagacttattaaggtcgacggcaaagtcaggactgatcctaactatcctgctggattcatggatgtgatcaccattgaaaaaactggtgaattcttccgtttgatctatgatgttaagggaagattcactattcacaggatcactgctgaagaagcaaaatacaaattgtgcaaagtccgcaaggtgcaaaccggaccaaaaggtattccattcttggtcacccacgatggtaggaccattaggtaccctgacccaatgatcaaggtaaacgacaccatccaactggaaatcgccacctcaaagatcctggactttatcaaattcgaatccggcaacttgtgcatgatcaccggaggcaggaatttgggtagagtgggaacggtagtgaacagggaaaggcatccgggatcattcgatattgtccacattagggacgctaatgatcacgtgttcgccactagattaaacaacgtattcgtcatcggtaaaggaagcaaagctttcgtgtctctgccaaggggcaagggagtgaaactgtccatcgctg

SEQ ID NO: 602 - protein, 242 aa, Anthonomus grandis
HLKRFAAPKAWMLDKLGGVFAPRPSTGPHKLRESLPLVIFLRNRLKYALTNCEVTKIVMQRLIKVDGKVRTDPNYPAGFMDVITIEKTGEFFRLIYDVKGRFTIHRITAEEAKYKLCKVRKVQTGPKGIPFLVTHDGRTIRYPDPMIKVNDTIQLEIATSKILDFIKFESGNLCMITGGRNLGRVGTVVNRERHPGSFDIVHIRDANDHVFATRLNNVFVIGKGSKAFVSLPRGKGVKLSIA

SEQ ID NO: 603 - DNA, 487 bp, Anthonomus grandis
ggtctggttggatccaaatgaaatcaatgagattgccaacaccaactcgaggcaaaacatccgtaaattgatcaaggatggtttgatcattaagaaaccggtggcagtgcactctagggctcgtgtccgtaaaaacacagaagctcgcaggaagggaaggcactgcggtttcggtaagaggaaaggtacagcgaacgctcgtatgcctcaaaaggaactatggatccaaaggatgcgtgtcttgaggcgtctcctgaaaaaatacagggaagccaaaaagatcgacaggcatctgtaccacgccctgtacatgaaggccaagggtaacgtgttcaagaacaagagagtgttgatggaatacatccacaagaagaaggctgagaaggcccgtgccaagatgttggccgaccaagctaacgccagaaggcaaaaggtgaaacaagtcccgtgagaggagggaagagcgtatcgccgcgaagaagcagga

SEQ ID NO: 604 - protein, 161 aa, Anthonomus grandis
VWLDPNEINEIANTNSRQNIRKLIKDGLIIKKPVAVHSRARVRKNTEARRKGRHCGFGKRKGTANARMPQKELWIQRMRVLRRLLKKYREAKKIDRHLYHALYMKAKGNVFKNKRVLMEYIHKKKAEKARAKMLADQANARRQKVKQVPEEGRAYRREEAG

SEQ ID NO: 605 - DNA, 904 bp, Anthonomus grandis
ctggcggccacatgcttatgggagactctttcaattcgtcgttgttcaaacaaactttccaaagggtgttcgcgaaggaccagaatggacatttgaagatggctttcaacggtactttggaggtgaagtgctctagggaattaaaagttcaaggcggtattggctcatgcgtgtcgctaaatgtaaaaagtcctttggtagcggacacggaaataggcatgggaaacaccgtgcaatggaagatgtgcaccttcaaccctagcacgacgatggcgctgtttttcgaggtggtcaatcagcattcggcccccattcctcaaggtggtagaggatgtatacagtttattacacaatatcagcactcgagtggccaaaggaggataagggtgacgacgatagcgagaaattgggcggacgcatcggcgaatattcaccacatcagcgcgggtttcgatcaggaacgtgccgcggtgattatggcccggatggctgtttatagagcggagaccgatgagagtcccgatgttttaagatgggtcgatcggatgctgattcgtttgtgtcaaaagtttggagaatataacaaagatgaccaggcatccttcagattaggagaaaattttagcttatacccgcaattcatgtaccacttaaggcgatcccagtttttgcaagtgttcaacaattcacctgacgaaacgtcgttttacaggcatatgcttatgagggaagatttgacacagtccctgataatgattcagccgatcttgtacagttacagttttaatggtcctccggagcccgttttgttggacaccagctcaatacaaccggacagaattctgcttatggacacgtttttccagatattgattttccatggagaaaccattgcccaatggcg

SEQ ID NO: 606 - protein, 300 aa, Anthonomus grandis
GGHMLMGDSFNSSLFKQTFQRVFAKDQNGHLKMAFNGTLEVKCSRELKVQGGIGSCVSLNVKSPLVADTEIGMGNTVQWKMCTFNPSTTMALFFEVVNQHSAPIPQGGRGCIQFITQYQHSSGQRRIRVTTIARNWADASANIHHISAGFDQERAAVIMARMAVYRAETDESPDVLRWVDRMLIRLCQKFGEYNKDDQASFRLGENFSLYPQFMYHLRRSQFLQVFNNSPDETSFYRHMLMREDLTQSLIMIQPILYSYSFNGPPEPVLLDTSSIQPDRILLMDTFFQILIFHGETIAQW

SEQ ID NO: 607 - DNA, 644 bp, Anthonomus grandis
cgcagatcaagcatatgatggccttcattgagcaagaggctaatgaaaaggccgaggaaattgatgccaaggcggaagaagaatttaacattgaaaagggccgccttgtgcaacaacaaagattgaagatcatggaatactatgagaagaaggagaagcaagtcgaactacaaaagaaaattcaatcctccaacatgctgaaccaagcccgtcttaaggttctgaaagtccgcgaagatcatgttagagctgtattggatgaggctcgcaagaagcttggtgaagtcaccagggatcaaggcaaatatgcccagattctggaatctttgatccttcagggactctaccagcttttcgaggcaaacgtgaccgtacgcgtccgcccacaagacagaaccttagtccaatcagtgctgccaaccatcgcaaccaaataccgtgacgtcaccggccgagatgtacacctgtccatcgatgacgaaactcaactgtccgaatccgtaaccggcggaatcgaacttttgtgcaaacaaaacaaaattaaggtctgcaacaccctggaggcacgtttggacctgatttcgcaacagttggttccgcaaatccgtaacgccttgttcggacgcaacatcaaccgcaagttc

SEQ ID NO: 608 - protein, 214 aa, Anthonomus grandis
QIKHMMAFIEQEANEKAEEIDAKAEEEFNIEKGRLVQQQRLKIMEYYEKKEKQVELQKKIQSSNMLNQARLKVLKVREDHVRAVLDEARKKLGEVTRDQGKYAQILESLILQGLYQLFEANVTVRVRPQDRTLVQSVLPTIATKYRDVTGRDVHLSIDDETQLSESVTGGIELLCKQNKIKVCNTLEARLDLISQQLVPQIRNALFGRNINRKF

SEQ ID NO: 609 - DNA, 734 bp, Anthonomus grandis
gtgtcggaggatatgttgggccgagtgttcaacggatcaggaaaacccattgacaaaggtcctccaatcttagccgaagatttcttggacatccaaggtcaacccatcaacccatggtcgcgtatctacccggaagaaatgatccagaccggtatctccgccatcgacgtgatgaactccatcgcgcgtgggcaaaaaatccccattttctccgcggccggtttaccgcacaacgaaatcgccgcccaaatctgtagacaggccggtttagtcaaactgccgggcaaatcggtaatcgacgatcacgaggacaatttcgccatcgtgttcgccgccatgggtgtcaacatggaaaccgcccgtttcttcaagcaggacttcgaagaaaacggttccatggagaacgtgtgtctcttcttgaatttggccaacgatcccaccatcgagagaatcatcacgccccgtttggctctgaccgccgccgaatttttggcttatcaatgcgagaaacacgtgctggttatcttaactgatatgtcttcttacgccgaggctttgcgtgaagtatccgccgccagagaagaagtacccggacgtcgtgggttccccggttacatgtacaccgatttggccaccatttacgaaagagccggtcgcgttgagggtagaaacggttccatcacccagattcccatcttgactatgccgaacgacgacatcacccatcctattcc

SEQ ID NO: 610 - protein, 244 aa, Anthonomus grandis
VSEDMLGRVFNGSGKPIDKGPPILAEDFLDIQGQPINPWSRIYPEEMIQTGISAIDVMNSIARGQKIPIFSAAGLPHNEIAAQICRQAGLVKLPGKSVIDDHEDNFAIVFAAMGVNMETARFFKQDFEENGSMENVCLFLNLANDPTIERIITPRLALTAAEFLAYQCEKHVLVILTDMSSYAEALREVSAAREEVPGRRGFPGYMYTDLATIYERAGRVEGRNGSITQIPILTMPNDDITHPI

SEQ ID NO: 611 - DNA, 23 bp, Artificial Sequence
  synthetic oligo
catttgaagcgtttwrmygcycc

SEQ ID NO: 612 - DNA, 23 bp, Artificial Sequence
  synthetic oligo
  misc_feature (18)..(18): n is a, c, g, or t
cgcttgtcccgctcctcngcrat

SEQ ID NO: 613 - DNA, 30 bp, Artificial Sequence
  synthetic oligo
ggtctggttggatcchaatgaaatcaayga

SEQ ID NO: 614 - DNA, 26 bp, Artificial Sequence
  synthetic oligo
tcctgcttcttsgyrgcratwcgytc

SEQ ID NO: 615 - DNA, 21 bp, Artificial Sequence
  synthetic oligo
ctggcggccacatgstbatgg

SEQ ID NO: 616 - DNA, 23 bp, Artificial Sequence
  synthetic oligo
cgccattgggcratggtytckcc

SEQ ID NO: 617 - DNA, 22 bp, Artificial Sequence
  synthetic oligo
cgcagatcaarcayatgatggc

SEQ ID NO: 618 - DNA, 24 bp, Artificial Sequence
  synthetic oligo
gaacttgcggttgabgttscgdcc

SEQ ID NO: 619 - DNA, 23 bp, Artificial Sequence
  synthetic oligo
gtgtcggaggatatgytgggycg

SEQ ID NO: 620 - DNA, 24 bp, Artificial Sequence
  synthetic oligo
ggaataggatgggtratrtcgtcg

SEQ ID NO: 621 - DNA, 26 bp, Anthonomus grandis
aaaactggtgaattcttccgtttgat

SEQ ID NO: 622 - DNA, 21 bp, Anthonomus grandis
aaagcatggatgttggacaaa

SEQ ID NO: 623 - DNA, 23 bp, Anthonomus grandis
aaagcatggatgttggacaaatt

SEQ ID NO: 624 - DNA, 26 bp, Anthonomus grandis
aaagcatggatgttggacaaattggg

SEQ ID NO: 625 - DNA, 32 bp, Anthonomus grandis; identical to SEQ ID NO: 279

SEQ ID NO: 626 - DNA, 23 bp, Anthonomus grandis
aaatacaaattgtgcaaagtccg

SEQ ID NO: 627 - DNA, 22 bp, Anthonomus grandis
aacttgtgcatgatcaccggag

SEQ ID NO: 628 - DNA, 27 bp, Anthonomus grandis
aagcatggatgttggacaaattggggg

SEQ ID NO: 629 - DNA, 34 bp, Anthonomus grandis
aagcatggatgttggacaaattggggggtgtgtt

SEQ ID NO: 630 - DNA, 23 bp, Anthonomus grandis
actggtgaattcttccgtttgat

SEQ ID NO: 631 - DNA, 44 bp, Anthonomus grandis
attgaaaaaactggtgaattcttccgtttgatctatgatgttaa

SEQ ID NO: 632 - DNA, 22 bp, Anthonomus grandis
ccaaagcatggatgttggacaa

SEQ ID NO: 633 - DNA, 23 bp, Anthonomus grandis
cccaaagcatggatgttggacaa

SEQ ID NO: 634 - DNA, 24 bp, Anthonomus grandis
cccaaagcatggatgttggacaaa

SEQ ID NO: 635 - DNA, 26 bp, Anthonomus grandis
cccaaagcatggatgttggacaaatt

SEQ ID NO: 636 - DNA, 29 bp, Anthonomus grandis
cccaaagcatggatgttggacaaattggg

SEQ ID NO: 637 - DNA, 31 bp, Anthonomus grandis
cccaaagcatggatgttggacaaattggggg

SEQ ID NO: 638 - DNA, 35 bp, Anthonomus grandis; identical to SEQ ID NO: 291

SEQ ID NO: 639 - DNA, 38 bp, Anthonomus grandis
cccaaagcatggatgttggacaaattggggggtgtgtt

SEQ ID NO: 640 - DNA, 21 bp, Anthonomus grandis
ctggattcatggatgtgatca

SEQ ID NO: 641 - DNA, 26 bp, Anthonomus grandis
gaattcttccgtttgatctatgatgt

SEQ ID NO: 642 - DNA, 23 bp, Anthonomus grandis
gcatggatgttggacaaattggg

SEQ ID NO: 643 - DNA, 25 bp, Anthonomus grandis
gcatggatgttggacaaattggggg

SEQ ID NO: 644 - DNA, 29 bp, Anthonomus grandis
gcatggatgttggacaaattggggggtgt

SEQ ID NO: 645 - DNA, 38 bp, Anthonomus grandis
gcatggatgttggacaaattggggggtgtgttcgcccc

SEQ ID NO: 646 - DNA, 26 bp, Anthonomus grandis
gcccccaaagcatggatgttggacaa

SEQ ID NO: 647 - DNA, 21 bp, Anthonomus grandis
gctggattcatggatgtgatc

SEQ ID NO: 648 - DNA, 23 bp, Anthonomus grandis
ggatcattcgatattgtccacat

SEQ ID NO: 649 - DNA, 26 bp, Anthonomus grandis
ggcaacttgtgcatgatcaccggagg

SEQ ID NO: 650 - DNA, 23 bp, Anthonomus grandis
tacaaattgtgcaaagtccgcaa

SEQ ID NO: 651 - DNA, 23 bp, Anthonomus grandis
tatcctgctggattcatggatgt

SEQ ID NO: 652 - DNA, 29 bp, Anthonomus grandis
tcaccattgaaaaaactggtgaattcttc

SEQ ID NO: 653 - DNA, 23 bp, Anthonomus grandis
tgcatgatcaccggaggcaggaa

SEQ ID NO: 654 - DNA, 29 bp, Anthonomus grandis
tgcatgatcaccggaggcaggaatttggg

SEQ ID NO: 655 - DNA, 26 bp, Anthonomus grandis
tggatgttggacaaattggggggtgt

SEQ ID NO: 656 - DNA, 22 bp, Anthonomus grandis
tgtgcatgatcaccggaggcag

SEQ ID NO: 657 - DNA, 31 bp, Anthonomus grandis
tgtgcatgatcaccggaggcaggaatttggg

SEQ ID NO: 658 - DNA, 25 bp, Anthonomus grandis
aagatcgacaggcatctgtaccacg

SEQ ID NO: 659 - DNA, 41 bp, Anthonomus grandis
aagatcgacaggcatctgtaccacgccctgtacatgaaggc

SEQ ID NO: 660 - DNA, 23 bp, Anthonomus grandis
aagggtaacgtgttcaagaacaa

SEQ ID NO: 661 - DNA, 24 bp, Anthonomus grandis
aagggtaacgtgttcaagaacaag

SEQ ID NO: 662 - DNA, 29 bp, Anthonomus grandis
aagggtaacgtgttcaagaacaagagagt

SEQ ID NO: 663 - DNA, 22 bp, Anthonomus grandis
acaagaagaaggctgagaaggc

SEQ ID NO: 664 - DNA, 23 bp, Anthonomus grandis
atcaaggatggtttgatcattaa

SEQ ID NO: 665 - DNA, 24 bp, Anthonomus grandis
atggaatacatccacaagaagaag

SEQ ID NO: 666 - DNA, 30 bp, Anthonomus grandis
caaaacatccgtaaattgatcaaggatggt

SEQ ID NO: 667 - DNA, 38 bp, Anthonomus grandis
caaaacatccgtaaattgatcaaggatggtttgatcat

SEQ ID NO: 668 - DNA, 21 bp, Anthonomus grandis
caagggtaacgtgttcaagaa

SEQ ID NO: 669 - DNA, 25 bp, Anthonomus grandis
caagggtaacgtgttcaagaacaag

SEQ ID NO: 670 - DNA, 29 bp, Anthonomus grandis
catctgtaccacgccctgtacatgaaggc

SEQ ID NO: 671 - DNA, 21 bp, Anthonomus grandis
gaagaaggctgagaaggcccg

SEQ ID NO: 672 - DNA, 35 bp, Anthonomus grandis
gacaggcatctgtaccacgccctgtacatgaaggc

SEQ ID NO: 673 - DNA, 24 bp, Anthonomus grandis
gagaaggcccgtgccaagatgttg

SEQ ID NO: 674 - DNA, 26 bp, Anthonomus grandis
gatccaaatgaaatcaatgagattgc

SEQ ID NO: 675 - DNA, 27 bp, Anthonomus grandis
gctcgtatgcctcaaaaggaactatgg

SEQ ID NO: 676 - DNA, 22 bp, Anthonomus grandis
gggtaacgtgttcaagaacaag

SEQ ID NO: 677 - DNA, 21 bp, Anthonomus grandis
ggtaacgtgttcaagaacaag

SEQ ID NO: 678 - DNA, 27 bp, Anthonomus grandis
tacatccacaagaagaaggctgagaag

SEQ ID NO: 679 - DNA, 23 bp, Anthonomus grandis
taccacgccctgtacatgaaggc

SEQ ID NO: 680 - DNA, 25 bp, Anthonomus grandis
tcaatgagattgccaacaccaactc

SEQ ID NO: 681 - DNA, 22 bp, Anthonomus grandis
tgatcaaggatggtttgatcat

SEQ ID NO: 682 - DNA, 28 bp, Anthonomus grandis
tgatcaaggatggtttgatcattaagaa

SEQ ID NO: 683 - DNA, 22 bp, Anthonomus grandis
tggttggatccaaatgaaatca

SEQ ID NO: 684 - DNA, 23 bp, Anthonomus grandis
tggttggatccaaatgaaatcaa

SEQ ID NO: 685 - DNA, 29 bp, Anthonomus grandis
tggttggatccaaatgaaatcaatgagat

SEQ ID NO: 686 - DNA, 25 bp, Anthonomus grandis
tgtaccacgccctgtacatgaaggc

SEQ ID NO: 687 - DNA, 22 bp, Anthonomus grandis
ttgatcaaggatggtttgatca

SEQ ID NO: 688 - DNA, 23 bp, Anthonomus grandis
ttgatcaaggatggtttgatcat

SEQ ID NO: 689 - DNA, 29 bp, Anthonomus grandis
ttgatggaatacatccacaagaagaaggc

SEQ ID NO: 690 - DNA, 23 bp, Anthonomus grandis
aggatgcgtgtcttgaggcgtct

SEQ ID NO: 691 - DNA, 30 bp, Anthonomus grandis
aaggccaagggtaacgtgttcaagaacaag

SEQ ID NO: 692 - DNA, 26 bp, Anthonomus grandis
cgtttgtgtcaaaagtttggagaata

SEQ ID NO: 693 - DNA, 23 bp, Anthonomus grandis
gatgttttaagatgggtcgatcg

SEQ ID NO: 694 - DNA, 32 bp, Anthonomus grandis
ttttacaggcatatgcttatgagggaagattt

SEQ ID NO: 695 - DNA, 29 bp, Anthonomus grandis
tttttcgaggtggtcaatcagcattcggc

SEQ ID NO: 696 - DNA, 21 bp, Anthonomus grandis
aacatgctgaaccaagcccgt

SEQ ID NO: 697 - DNA, 23 bp, Anthonomus grandis
aacatgctgaaccaagcccgtct

SEQ ID NO: 698 - DNA, 26 bp, Anthonomus grandis
aagatcatggaatactatgagaagaa

SEQ ID NO: 699 - DNA, 32 bp, Anthonomus grandis
aagatcatggaatactatgagaagaaggagaa

SEQ ID NO: 700 - DNA, 26 bp, Anthonomus grandis
aatgaaaaggccgaggaaattgatgc

SEQ ID NO: 701 - DNA, 23 bp, Anthonomus grandis
atggaatactatgagaagaagga

SEQ ID NO: 702 - DNA, 23 bp, Anthonomus grandis
caatcctccaacatgctgaacca

SEQ ID NO: 703 - DNA, 26 bp, Anthonomus grandis
cagatcaagcatatgatggccttcat

SEQ ID NO: 704 - DNA, 27 bp, Anthonomus grandis
gcagatcaagcatatgatggccttcat

SEQ ID NO: 705 - DNA, 29 bp, Anthonomus grandis
gcggaagaagaatttaacattgaaaaggg

SEQ ID NO: 706 - DNA, 25 bp, Anthonomus grandis
aacgacgacatcacccatcctattc

SEQ ID NO: 707 - DNA, 23 bp, Anthonomus grandis
aacggttccatggagaacgtgtg

SEQ ID NO: 708 - DNA, 26 bp, Anthonomus grandis
aacggttccatggagaacgtgtgtct

SEQ ID NO: 709 - DNA, 35 bp, Anthonomus grandis
aacggttccatggagaacgtgtgtctcttcttgaa

SEQ ID NO: 710 - DNA, 23 bp, Anthonomus grandis
atgatccagaccggtatctccgc

SEQ ID NO: 711 - DNA, 26 bp, Anthonomus grandis
atgccgaacgacgacatcacccatcc

SEQ ID NO: 712 - DNA, 23 bp, Anthonomus grandis
caatgcgagaaacacgtgctggt

SEQ ID NO: 713 - DNA, 26 bp, Anthonomus grandis
ccgcacaacgaaatcgccgcccaaat

SEQ ID NO: 714 - DNA, 23 bp, Anthonomus grandis
cgtttcttcaagcaggacttcga

SEQ ID NO: 715 - DNA, 36 bp, Anthonomus grandis
cttggacatccaaggtcaacccatcaacccatggtc

SEQ ID NO: 716 - DNA, 23 bp, Anthonomus grandis
gaaatgatccagaccggtatctc

SEQ ID NO: 717 - DNA, 44 bp, Anthonomus grandis
gaaatgatccagaccggtatctccgccatcgacgtgatgaactc

SEQ ID NO: 718 - DNA, 23 bp, Anthonomus grandis
gaagaaatgatccagaccggtat

SEQ ID NO: 719 - DNA, 23 bp, Anthonomus grandis
gaagaagtacccggacgtcgtgg

SEQ ID NO: 720 - DNA, 23 bp, Anthonomus grandis
gacatccaaggtcaacccatcaa

SEQ ID NO: 721 - DNA, 26 bp, Anthonomus grandis
gcccgtttcttcaagcaggacttcga

SEQ ID NO: 722 - DNA, 23 bp, Anthonomus grandis
gccgcccaaatctgtagacaggc

SEQ ID NO: 723 - DNA, 29 bp, Anthonomus grandis
ggatcaggaaaacccattgacaaaggtcc

SEQ ID NO: 724 - DNA, 23 bp, Anthonomus grandis
ggttacatgtacaccgatttggc

SEQ ID NO: 725 - DNA, 29 bp, Anthonomus grandis
ggttacatgtacaccgatttggccaccat

SEQ ID NO: 726 - DNA, 36 bp, Anthonomus grandis
ggttacatgtacaccgatttggccaccatttacgaa

SEQ ID NO: 727 - DNA, 23 bp, Anthonomus grandis
gtgtcggaggatatgttgggccg

SEQ ID NO: 728 - DNA, 26 bp, Anthonomus grandis
tacatgtacaccgatttggccaccat

SEQ ID NO: 729 - DNA, 35 bp, Anthonomus grandis
ttcaacggatcaggaaaacccattgacaaaggtcc

SEQ ID NO: 730 - DNA, 32 bp, Anthonomus grandis
ttccccggttacatgtacaccgatttggccac

SEQ ID NO: 731 - DNA, 35 bp, Anthonomus grandis
ttccccggttacatgtacaccgatttggccaccat

SEQ ID NO: 732 - DNA, 38 bp, Anthonomus grandis
ttccccggttacatgtacaccgatttggccaccattta

SEQ ID NO: 733 - DNA, 41 bp, Anthonomus grandis
ttccccggttacatgtacaccgatttggccaccatttacga

SEQ ID NO: 734 - DNA, 29 bp, Anthonomus grandis
ttcgccatcgtgttcgccgccatgggtgt

SEQ ID NO: 735 - DNA, 23 bp, Anthonomus grandis
ttcttcaagcaggacttcgaaga

SEQ ID NO: 736 - DNA, 23 bp, Anthonomus grandis
ttcttgaatttggccaacgatcc

SEQ ID NO: 737 - DNA, 33 bp, Anthonomus grandis
ttcttgaatttggccaacgatcccaccatcgag

SEQ ID NO: 738 - DNA, 23 bp, Anthonomus grandis
gccgaatttttggcttatcaatg

SEQ ID NO: 739 - DNA, 22 bp, Anthonomus grandis
gctggattcatggatgtgatca

SEQ ID NO: 740 - DNA, 21 bp, Anthonomus grandis
atggatgttggacaaattggg

SEQ ID NO: 741 - DNA, 23 bp, Anthonomus grandis
ttcatggatgtgatcaccattga

SEQ ID NO: 742 - DNA, 29 bp, Anthonomus grandis
gtctggttggatccaaatgaaatcaatga

SEQ ID NO: 743 - DNA, 21 bp, Anthonomus grandis
ggatccaaatgaaatcaatga

SEQ ID NO: 744 - DNA, 22 bp, Anthonomus grandis
tgatcaaggatggtttgatcat

SEQ ID NO: 745 - DNA, 26 bp, Anthonomus grandis
tggttggatccaaatgaaatcaatga

SEQ ID NO: 746 - DNA, 26 bp, Anthonomus grandis
ccaagggtaacgtgttcaagaacaag

SEQ ID NO: 747 - DNA, 26 bp, Anthonomus grandis
tggttggatccaaatgaaatcaatga

SEQ ID NO: 748 - DNA, 22 bp, Anthonomus grandis
tggatccaaatgaaatcaatga

SEQ ID NO: 749 - DNA, 23 bp, Anthonomus grandis
gaagaatttaacattgaaaaggg

SEQ ID NO: 750 - DNA, 23 bp, Anthonomus grandis
gaatttaacattgaaaagggccg

SEQ ID NO: 751 - DNA, 23 bp, Anthonomus grandis
ggttacatgtacaccgatttggc

SEQ ID NO: 752 - DNA, 23 bp, Anthonomus grandis
cgtaacaggttgaagtacgccct

SEQ ID NO: 753 - DNA, 27 bp, Anthonomus grandis
aaggtcgacggcaaagtcaggactgat

SEQ ID NO: 754 - DNA, 22 bp, Anthonomus grandis
ccattcttggtcacccacgatg

SEQ ID NO: 755 - DNA, 21 bp, Anthonomus grandis
atcaaggtaaacgacaccatc

SEQ ID NO: 756 - DNA, 38 bp, Anthonomus grandis
tgtacatgaaggccaagggtaacgtgttcaagaacaag

SEQ ID NO: 757 - DNA, 26 bp, Anthonomus grandis
ccaagggtaacgtgttcaagaacaag

SEQ ID NO: 758 - DNA, 24 bp, Anthonomus grandis
aagggtaacgtgttcaagaacaag

SEQ ID NO: 759 - DNA, 21 bp, Anthonomus grandis
caagaagaaggctgagaaggc

SEQ ID NO: 760 - DNA, 21 bp, Anthonomus grandis
caagaagaaggctgagaaggc

SEQ ID NO: 761 - DNA, 21 bp, Anthonomus grandis
aagaagaaggctgagaaggcc

SEQ ID NO: 762 - DNA, 32 bp, Anthonomus grandis
caaaacatccgtaaattgatcaaggatggttt

SEQ ID NO: 763 - DNA, 21 bp, Anthonomus grandis
ttcgccgccatgggtgtcaac

SEQ ID NO: 764 - DNA, 23 bp, Anthonomus grandis
atgggtgtcaacatggaaaccgc

SEQ ID NO: 765 - DNA, 21 bp, Anthonomus grandis
tggaaaccgcccgtttcttca

SEQ ID NO: 766 - DNA, 21 bp, Anthonomus grandis
ggttacatgtacaccgatttg

SEQ ID NO: 767 - DNA, 26 bp, Anthonomus grandis
gtcaagatgggaatctgggtgatgga

SEQ ID NO: 768 - DNA, 444 bp, Anthonomus grandis
gcatggatgttggacaaattggggggtgtgttcgcccccaggccctccaccgggccacacaagctcagggagtcccttccattagtgattttcttgcgtaacaggttgaagtacgccctgacaaactgtgaggtgaccaagatcgttatgcagagacttattaaggtcgacggcaaagtcaggactgatcctaactatcctgctggattcatggatgtgatcaccattgaaaaaactggtgaattcttccgtttgatctatgatgttaagggaagattcactattcacaggatcactgctgaagaagcaaaatacaaattgtgcaaagtccgcaaggtgcaaaccggaccaaaaggtattccattcttggtcacccacgatggtaggaccattaggtaccctgacccaatgatcaaggtaaacgacaccatccaactggaaatc

SEQ ID NO: 769 - DNA, 44 bp, Artificial Sequence
  synthetic oligo
gcgtaatacgactcactatagggcatggatgttggacaaattgg

SEQ ID NO: 770 - DNA, 22 bp, Artificial Sequence
  synthetic oligo
gatttccagttggatggtgtcg

SEQ ID NO: 771 - DNA, 22 bp, Artificial Sequence
  synthetic oligo
gcatggatgttggacaaattgg

SEQ ID NO: 772 - DNA, 44 bp, Artificial Sequence
  synthetic oligo
gcgtaatacgactcactatagggatttccagttggatggtgtcg

SEQ ID NO: 773 - DNA, 398 bp, Anthonomus grandis
caacaccaactcgaggcaaaacatccgtaaattgatcaaggatggtttgatcattaagaaaccggtggcagtgcactctagggctcgtgtccgtaaaaacacagaagctcgcaggaagggaaggcactgcggtttcggtaagaggaaaggtacagcgaacgctcgtatgcctcaaaaggaactatggatccaaaggatgcgtgtcttgaggcgtctcctgaaaaaatacagggaagccaaaaagatcgacaggcatctgtaccacgccctgtacatgaaggccaagggtaacgtgttcaagaacaagagagtgttgatggaatacatccacaagaagaaggctgagaaggcccgtgccaagatgttggccgaccaagctaacgccagaaggcaaaagg

SEQ ID NO: 774 - DNA, 44 bp, Artificial Sequence
  synthetic oligo
gcgtaatacgactcactataggcaacaccaactcgaggcaaaac

SEQ ID NO: 775 - DNA, 21 bp, Artificial Sequence
  synthetic oligo
ccttttgccttctggcgttag

SEQ ID NO: 776 - DNA, 22 bp, Artificial Sequence
  synthetic oligo
caacaccaactcgaggcaaaac

SEQ ID NO: 777 - DNA, 43 bp, Artificial Sequence
  synthetic oligo
gcgtaatacgactcactataggccttttgccttctggcgttag

SEQ ID NO: 778 - DNA, 555 bp, Anthonomus grandis
caaactttccaaagggtgttcgcgaaggaccagaatggacatttgaagatggctttcaacggtactttggaggtgaagtgctctagggaattaaaagttcaaggcggtattggctcatgcgtgtcgctaaatgtaaaaagtcctttggtagcggacacggaaataggcatgggaaacaccgtgcaatggaagatgtgcaccttcaaccctagcacgacgatggcgctgtttttcgaggtggtcaatcagcattcggcccccattcctcaaggtggtagaggatgtatacagtttattacacaatatcagcactcgagtggccaaaggaggataagggtgacgacgatagcgagaaattgggcggacgcatcggcgaatattcaccacatcagcgcgggtttcgatcaggaacgtgccgcggtgattatggcccggatggctgtttatagagcggagaccgatgagagtcccgatgttttaagatgggtcgatcggatgctgattcgtttgtgtcaaaagtttggagaatataacaaagatgaccaggcatccttc

SEQ ID NO: 779 - DNA, 44 bp, Artificial Sequence
  synthetic oligo
gcgtaatacgactcactataggcaaactttccaaagggtgttcg

SEQ ID NO: 780 - DNA, 22 bp, Artificial Sequence
  synthetic oligo
gaaggatgcctggtcatctttg

SEQ ID NO: 781 - DNA, 22 bp, Artificial Sequence
  synthetic oligo
caaactttccaaagggtgttcg

SEQ ID NO: 782 - DNA, 44 bp, Artificial Sequence
  synthetic oligo
gcgtaatacgactcactatagggaaggatgcctggtcatctttg

SEQ ID NO: 783 - DNA, 549 bp, Anthonomus grandis
gaaaaggccgaggaaattgatgccaaggcggaagaagaatttaacattgaaaagggccgccttgtgcaacaacaaagattgaagatcatggaatactatgagaagaaggagaagcaagtcgaactacaaaagaaaattcaatcctccaacatgctgaaccaagcccgtcttaaggttctgaaagtccgcgaagatcatgttagagctgtattggatgaggctcgcaagaagcttggtgaagtcaccagggatcaaggcaaatatgcccagattctggaatctttgatccttcagggactctaccagcttttcgaggcaaacgtgaccgtacgcgtccgcccacaagacagaaccttagtccaatcagtgctgccaaccatcgcaaccaaataccgtgacgtcaccggccgagatgtacacctgtccatcgatgacgaaactcaactgtccgaatccgtaaccggcggaatcgaacttttgtgcaaacaaaacaaaattaaggtctgcaacaccctggaggcacgtttggacctgatttcgcaacagttg

SEQ ID NO: 784 - DNA, 44 bp, Artificial Sequence
  synthetic oligo
gcgtaatacgactcactatagggaaaaggccgaggaaattgatg

SEQ ID NO: 785 - DNA, 22 bp, Artificial Sequence
  synthetic oligo
caactgttgcgaaatcaggtcc

SEQ ID NO: 786 - DNA, 22 bp, Artificial Sequence
  synthetic oligo
gaaaaggccgaggaaattgatg

SEQ ID NO: 787 - DNA, 44 bp, Artificial Sequence
  synthetic oligo
gcgtaatacgactcactataggcaactgttgcgaaatcaggtcc

SEQ ID NO: 788 - DNA, 632 bp, Anthonomus grandis
gtgttcaacggatcaggaaaacccattgacaaaggtcctccaatcttagccgaagatttcttggacatccaaggtcaacccatcaacccatggtcgcgtatctacccggaagaaatgatccagaccggtatctccgccatcgacgtgatgaactccatcgcgcgtgggcaaaaaatccccattttctccgcggccggtttaccgcacaacgaaatcgccgcccaaatctgtagacaggccggtttagtcaaactgccgggcaaatcggtaatcgacgatcacgaggacaatttcgccatcgtgttcgccgccatgggtgtcaacatggaaaccgcccgtttcttcaagcaggacttcgaagaaaacggttccatggagaacgtgtgtctcttcttgaatttggccaacgatcccaccatcgagagaatcatcacgccccgtttggctctgaccgccgccgaatttttggcttatcaatgcgagaaacacgtgctggttatcttaactgatatgtcttcttacgccgaggctttgcgtgaagtatccgccgccagagaagaagtacccggacgtcgtgggttccccggttacatgtacaccgatttggccaccatttacgaaagagccggtcg

SEQ ID NO: 789 - DNA, 45 bp, Artificial Sequence
  synthetic oligo
gcgtaatacgactcactatagggtgttcaacggatcaggaaaacc

SEQ ID NO: 790 - DNA, 21 bp, Artificial Sequence
  synthetic oligo
cgaccggctctttcgtaaatg

SEQ ID NO: 791 - DNA, 23 bp, Artificial Sequence
  synthetic oligo
gtgttcaacggatcaggaaaacc

SEQ ID NO: 792 - DNA, 43 bp, Artificial Sequence
  synthetic oligo
gcgtaatacgactcactataggcgaccggctctttcgtaaatg

SEQ ID NO: 793 - DNA, 642 bp, Tribolium castaneum
ggccccaagaagcatttgaagcgtctcaatgcgcccaaagcatggatgttggataaactggggggtgtgtttgcccctcggccttccaccggcccccacaagctacgggagtcgctacctttggttatcttcctgcgaaacaggctgaagtatgccttgaccaactcagaagtgacgaagattgttatgcaaagattgattaaagttgacggaaaagttaggacagaccccaactaccccgcgggtttcatggatgttgtgactattgagaaaactggggaattcttccgcttgatttatgatgttaagggaaggttcacaatccatcgcattactggagaagaggccaaatataaattgtgcaaagtgaagaaagtacagacaggccccaagggcattcccttcttggtgacccgcgacggacgcactatcagatacccagaccccatgatcaaagtgaatgacaccattcaattggagattgccacttcgaaaattcttgattttatcaaatttgagtccggtaatttgtgtatgattactggaggtcgtaacttggggcgtgtcggtacagtggtgagccgagaacgtcacccaggttccttcgacatcgttcatattaaggatgcaaatgggcacacc

SEQ ID NO: 794 - protein, 245 aa, Tribolium castaneum
GPKKHLKRLNAPKAWMLDKLGGVFAPRPSTGPHKLRESLPLVIFLRNRLKYALTNSEVTKIVMQRLIKVDGKVRTDPNYPAGFMDVVTIEKTGEFFRLIYDVKGRFTIHRITGEEAKYKLCKVKKVQTGPKGIPFLVTRDGRTIRYPDPMIKVNDTIQLEIATSKILDFIKFESGNLCMITGGRNLGRVGTVVSRERHPGSFDIVHIKDANGHTFATRLNNVFIIGKGSKPYVSLPRGKGVKLSI

SEQ ID NO: 795 - DNA, 290 bp, Tribolium castaneum
caggagttcctggaggctaaaatcgaccaagagatcctcacagcgaagaaaaacgcgtcgaaaaacaaacgagcggccatccaggccatcaagaggaagaaacgctacgaaaagcagctccagcagatcgatggcaccctcagcaccatcgagatgcagcgggaggccctcgagggggccaacaccaacacagccgtactcaaaacgatgaaaaacgcagcggacgccctcaaaaatgcccacctcaacatggatgttgatgaggtacatgacatgatggatgacattgc

SEQ ID NO: 796 - protein, 96 aa, Tribolium castaneum
QEFLEAKIDQEILTAKKNASKNKRAAIQAIKRKKRYEKQLQQIDGTLSTIEMQREALEGANTNTAVLKTMKNAADALKNAHLNMDVDEVHDMMDDI

SEQ ID NO: 797 - DNA, 384 bp, Tribolium castaneum
aaaattcggcgaatacaacaaagacgaccctaacagtttccgtttgagtgaaaacttcagtctctatccccaattcatgtaccatttgcgccgctcccaattcctccaagttttcaacaactccccagacgagacctcgttctaccgccacatgctgatgcgggaggacctcacccaaagtctcattatgatccagccgattttgtacagttatagtttcaacggcccccctgaacccgtcctcctcgacactagttccattcaacccgatcggatccttctcatggacacatttttccaaattttgattttccacggtgagacaatcgcccaatggaggaacctcaagtaccaggacatgcccgaatacgagaacttccggca

SEQ ID NO: 798 - protein, 127 aa, Tribolium castaneum
PEVLVFGHVLVLEVPPLGDCLTVENQNLEKCVHEKDPIGLNGTSVEEDGFRGAVETITVQNRLDHNETLGEVLPHQHVAVERGLVWGVVENLEELGAAQMVHELGIETEVFTQTETVRVVFVVFAEF

SEQ ID NO: 799 - DNA, 621 bp, Tribolium castaneum
gagaaagccgaagaaatcgatgcgaaagctgaggaggagtttaacattgaaaaagggcgcctggtccaacaacagcgcttgaagatcatggaatattacgagaagaaggagaaaccggtggaattgcagaagaaaattcagtcgtcaaacatgctgaaccaagcccgtttgaaagtattaaaagtgcgtgaagaccacgtccacaatgtgctggatgacgcccgcaaacgtctgggcgaaatcaccaatgaccaggcgagatattcacaacttttggagtctcttatcctccagagtctctaccagtacttgggaatcagtgatgagttgtttgagaacaatatagtggtgagagtcaggcaacaggacaggagtataatccagggcattctcccagttgttgcgacgaaatacagggacgccactggtaaagacgttcatcttaaaatcgacgatgagagccacttgccatccgaaaccaccggaggagtggttttgtatgcgcaaaagggtaaaatcaagattgacaacaccttggaggctcgtttggatttaattgcacagcaacttgtgccagaaattcgtacggccttgtttggacgcaacatcaaccgcaagttc

SEQ ID NO: 800 - protein, 207 aa, Tribolium castaneum
EKAEEIDAKAEEEFNIEKGRLVQQQRLKIMEYYEKKEKPVELQKKIQSSNMLNQARLKVLKVREDHVHNVLDDARKRLGEITNDQARYSQLLESLILQSLYQYLGISDELFENNIVVRVRQQDRSIIQGILPVVATKYRDATGKDVHLKIDDESHLPSETTGGVVLYAQKGKIKIDNTLEARLDLIAQQLVPEIRTALFGRNINRKF

SEQ ID NO: 801 - DNA, 957 bp, Tribolium castaneum
ggatgaactacagctgttccgtggcgatacagtgttgctgaaagggaagcggcggaaagagaccgtctgcattgtgctggccgacgaaaactgccccgatgagaagatccggatgaacaggatcgtcaggaataatctacgggttaggctctctgacgtcgtctggatccagccctgtcccgacgtcaaatacgggaagaggatccacgttttgcccatcgatgacacggtcgaagggctcgtcggaaatctcttcgaggtgtacttaaaaccatacttcctcgaagcttatcgaccaatccacaaaggcgacgttttcatcgtccgtggtggcatgcgagccgttgaattcaaagtggtggaaacggaaccgtcaccatattgtatcgtcgcccccgataccgtcatccattgtgacggcgatccgatcaaacgagaagaagaggaggaagccttgaacgccgtcggctacgacgatatcggcggttgtcgcaaacaactcgcacaaatcaaagaaatggtcgaattacctctacgccacccgtcgctcttcaaggccattggcgtgaaaccaccacgtggtatcctcttgtacggacctccaggtaccggtaaaactttaatcgcacgtgcagtggccaacgaaaccggtgctttcttcttcttaatcaacggtcccgaaattatgagtaaattagccggcgaatccgaaagtaatctaaggaaagcgttcgaagaagccgataaaaactcaccggctattattttcatcgatgaattggacgcgattgcaccgaaacgtgaaaaaacccacggcgaagtcgaacgccgaattgtctcgcaattgttaacactgatggacggcatgaagaaaagctcgcatgttatcgtgatggcggccacaaatcgcccgaactcaatcgatccggctttgcgtcggttcggtcgctttgatcg

SEQ ID NO: 802 - protein, 318 aa, Tribolium castaneum
DELQLFRGDTVLLKGKRRKETVCIVLADENCPDEKIRMNRIVRNNLRVRLSDVVWIQPCPDVKYGKRIHVLPIDDTVEGLVGNLFEVYLKPYFLEAYRPIHKGDVFIVRGGMRAVEFKVVETEPSPYCIVAPDTVIHCDGDPIKREEEEEALNAVGYDDIGGCRKQLAQIKEMVELPLRHPSLFKAIGVKPPRGILLYGPPGTGKTLIARAVANETGAFFFLINGPEIMSKLAGESESNLRKAFEEADKNSPAIIFIDELDAIAPKREKTHGEVERRIVSQLLTLMDGMKKSSHVIVMAATNRPNSIDPALRRFGRFD

SEQ ID NO: 803 - DNA, 23 bp, Artificial Sequence
  synthetic oligo
ggccccaagaagcatttgaagcg

SEQ ID NO: 804 - DNA, 23 bp, Artificial Sequence
  synthetic oligo
  misc_feature (18)..(18): n is a, c, g, or t
cgcttgtcccgctcctcngcrat

SEQ ID NO: 805 - DNA, 26 bp, Artificial Sequence
  synthetic oligo
caggagttcctggarrmbaaratmga

SEQ ID NO: 806 - DNA, 26 bp, Artificial Sequence
  synthetic oligo
gcaatgtcatccatcakrtcrtgtac

SEQ ID NO: 807 - DNA, 22 bp, Artificial Sequence
  synthetic oligo
gcattctgcgctgggtcgatcg

SEQ ID NO: 808 - DNA, 24 bp, Artificial Sequence
  synthetic oligo
tgccggaagttctcrtaytckggc

SEQ ID NO: 809 - DNA, 23 bp, Artificial Sequence
  synthetic oligo
gagaaagccgargaratygatgc

SEQ ID NO: 810 - DNA, 24 bp, Artificial Sequence
  synthetic oligo
gaacttgcggttgabgttscgdcc

SEQ ID NO: 811 - DNA, 24 bp, Artificial Sequence
  synthetic oligo
ggatgaactacagctbttccghgg

SEQ ID NO: 812 - DNA, 23 bp, Artificial Sequence
  synthetic oligo
cgatcaaagcgwccraavcgacg

SEQ ID NO: 813 - DNA, 21 bp, Tribolium castaneum
aaagcatggatgttggataaa

SEQ ID NO: 814 - DNA, 23 bp, Tribolium castaneum
aatttgtgtatgattactggagg

SEQ ID NO: 815 - DNA, 26 bp, Tribolium castaneum
actggaggtcgtaacttggggcgtgt

SEQ ID NO: 816 - DNA, 32 bp, Tribolium castaneum
atgattactggaggtcgtaacttggggcgtgt

SEQ ID NO: 817 - DNA, 26 bp, Tribolium castaneum
atgcaaagattgattaaagttgacgg

SEQ ID NO: 818 - DNA, 21 bp, Tribolium castaneum
attaaagttgacggaaaagtt

SEQ ID NO: 819 - DNA, 26 bp, Tribolium castaneum
attgagaaaactggggaattcttccg

SEQ ID NO: 820 - DNA, 38 bp, Tribolium castaneum
attgttatgcaaagattgattaaagttgacggaaaagt

SEQ ID NO: 821 - DNA, 22 bp, Tribolium castaneum
ccaagaagcatttgaagcgtct

SEQ ID NO: 822 - DNA, 23 bp, Tribolium castaneum
ccaagaagcatttgaagcgtctc

SEQ ID NO: 823 - DNA, 23 bp, Tribolium castaneum
gcgcccaaagcatggatgttgga

SEQ ID NO: 824 - DNA, 24 bp, Tribolium castaneum
ggccccaagaagcatttgaagcgt

SEQ ID NO: 825 - DNA, 31 bp, Tribolium castaneum
tgattactggaggtcgtaacttggggcgtgt

SEQ ID NO: 826 - DNA, 35 bp, Tribolium castaneum
tgtatgattactggaggtcgtaacttggggcgtgt

SEQ ID NO: 827 - DNA, 21 bp, Tribolium castaneum
ttgatttatgatgttaaggga

SEQ ID NO: 828 - DNA, 26 bp, Tribolium castaneum
ttgtgtatgattactggaggtcgtaa

SEQ ID NO: 829 - DNA, 26 bp, Tribolium castaneum
aaaaacaaacgagcggccatccaggc

SEQ ID NO: 830 - DNA, 66 bp, Tribolium castaneum
atcgaccaagagatcctcacagcgaagaaaaacgcgtcgaaaaacaaacgagcggccatccaggcc

SEQ ID NO: 831 - DNA, 23 bp, Tribolium castaneum
ctccagcagatcgatggcaccct

SEQ ID NO: 832 - DNA, 178 bp, Tribolium castaneum
tcaagaggaagaaacgctacgaaaagcagctccagcagatcgatggcaccctcagcaccatcgagatgcagcgggaggccctcgagggggccaacaccaacacagccgtactcaaaacgatgaaaaacgcagcggacgccctcaaaaatgcccacctcaacatggatgttgatgaggt

SEQ ID NO: 833 - DNA, 26 bp, Tribolium castaneum
aacctcaagtaccaggacatgcccga

SEQ ID NO: 834 - DNA, 21 bp, Tribolium castaneum
agccgattttgtacagttata

SEQ ID NO: 835 - DNA, 21 bp, Tribolium castaneum
atggacacatttttccaaatt

SEQ ID NO: 836 - DNA, 35 bp, Tribolium castaneum
atggacacatttttccaaattttgattttccacgg

SEQ ID NO: 837 - DNA, 21 bp, Tribolium castaneum
caagtaccaggacatgcccga

SEQ ID NO: 838 - DNA, 24 bp, Tribolium castaneum
cacatgctgatgcgggaggacctc

SEQ ID NO: 839 - DNA, 24 bp, Tribolium castaneum
cctcaagtaccaggacatgcccga

SEQ ID NO: 840 - DNA, 22 bp, Tribolium castaneum
tcaagtaccaggacatgcccga

SEQ ID NO: 841 - DNA, 23 bp, Tribolium castaneum
ttcatgtaccatttgcgccgctc

SEQ ID NO: 842 - DNA, 26 bp, Tribolium castaneum
aaaattcagtcgtcaaacatgctgaa

SEQ ID NO: 843 - DNA, 21 bp, Tribolium castaneum
aacatgctgaaccaagcccgt

SEQ ID NO: 844 - DNA, 22 bp, Tribolium castaneum
cacagcaacttgtgccagaaat

SEQ ID NO: 845 - DNA, 23 bp, Tribolium castaneum
gagaaagccgaagaaatcgatgc

SEQ ID NO: 846 - DNA, 21 bp, Tribolium castaneum
gcccgcaaacgtctgggcgaa

SEQ ID NO: 847 - DNA, 22 bp, Tribolium castaneum
taaaagtgcgtgaagaccacgt

SEQ ID NO: 848 - DNA, 23 bp, Tribolium castaneum
acactgatggacggcatgaagaa

SEQ ID NO: 849 - DNA, 23 bp, Tribolium castaneum
atcggcggttgtcgcaaacaact

SEQ ID NO: 850 - DNA, 23 bp, Tribolium castaneum
cccgatgagaagatccggatgaa

SEQ ID NO: 851 - DNA, 21 bp, Tribolium castaneum
ctgccccgatgagaagatccg

SEQ ID NO: 852 - DNA, 23 bp, Tribolium castaneum
aacgaaaccggtgctttcttctt

SEQ ID NO: 853 - DNA, 23 bp, Tribolium castaneum
atcatggaatattacgagaagaa

SEQ ID NO: 854 - DNA, 26 bp, Tribolium castaneum
aacggtcccgaaattatgagtaaatt

SEQ ID NO: 855 - DNA, 24 bp, Tribolium castaneum
aacaggctgaagtatgccttgacc

SEQ ID NO: 856 - DNA, 21 bp, Tribolium castaneum
ttcatcgtccgtggtggcatg

SEQ ID NO: 857 - DNA, 21 bp, Tribolium castaneum
agttttaccggtacctggagg

SEQ ID NO: 858 - DNA, 21 bp, Tribolium castaneum
cctccaggtaccggtaaaact

SEQ ID NO: 859 - DNA, 23 bp, Tribolium castaneum
cctccaggtaccggtaaaacttt

SEQ ID NO: 860 - DNA, 26 bp, Tribolium castaneum
attaaagttttaccggtacctggagg

SEQ ID NO: 861 - DNA, 23 bp, Tribolium castaneum
ggtgctttcttcttcttaatcaa

SEQ ID NO: 862 - DNA, 21 bp, Tribolium castaneum
atcaacggtcccgaaattatg

SEQ ID NO: 863 - DNA, 510 bp, Tribolium castaneum
ctgcgaaacaggctgaagtatgccttgaccaactcagaagtgacgaagattgttatgcaaagattgattaaagttgacggaaaagttaggacagaccccaactaccccgcgggtttcatggatgttgtgactattgagaaaactggggaattcttccgcttgatttatgatgttaagggaaggttcacaatccatcgcattactggagaagaggccaaatataaattgtgcaaagtgaagaaagtacagacaggccccaagggcattcccttcttggtgacccgcgacggacgcactatcagatacccagaccccatgatcaaagtgaatgacaccattcaattggagattgccacttcgaaaattcttgattttatcaaatttgagtccggtaatttgtgtatgattactggaggtcgtaacttggggcgtgtcggtacagtggtgagccgagaacgtcacccaggttccttcgacatcgttcatattaaggatgcaaatgggcacacc

SEQ ID NO: 864 - DNA, 45 bp, Artificial Sequence
  synthetic oligo
gcgtaatacgactcactataggctgcgaaacaggctgaagtatgc

SEQ ID NO: 865 - DNA, 20 bp, Artificial Sequence
  synthetic oligo
ggtgtgcccatttgcatcct

SEQ ID NO: 866 - DNA, 23 bp, Artificial Sequence
  synthetic oligo
ctgcgaaacaggctgaagtatgc

SEQ ID NO: 867 - DNA, 42 bp, Artificial Sequence
  synthetic oligo
gcgtaatacgactcactataggggtgtgcccatttgcatcct

SEQ ID NO: 868 - DNA, 195 bp, Tribolium castaneum
catccatgttgaggtgggcatttttgagggcgtccgctgcgtttttcatcgttttgagtacggctgtgttggtgttggccccctcgagggcctcccgctgcatctcgatggtgctgagggtgccatcgatctgctggagctgcttttcgtagcgtttcttcctcttgatggcctggatggccgctgttcacaaag

SEQ ID NO: 869 - DNA, 42 bp, Artificial Sequence
  synthetic oligo
gcgtaatacgactcactataggcatccatgttgaggtgggca

SEQ ID NO: 870 - DNA, 20 bp, Artificial Sequence
  synthetic oligo
ctttgtgaacagcggccatc

SEQ ID NO: 871 - DNA, 20 bp, Artificial Sequence
  synthetic oligo
catccatgttgaggtgggca

SEQ ID NO: 872 - DNA, 42 bp, Artificial Sequence
  synthetic oligo
gcgtaatacgactcactataggctttgtgaacagcggccatc

SEQ ID NO: 873 - DNA, 284 bp, Tribolium castaneum
atgtcctggtacttgaggttcctccattgggcgattgtctcaccgtggaaaatcaaaatttggaaaaatgtgtccatgagaaggatccgatcgggttgaatggaactagtgtcgaggaggacgggttcaggggggccgttgaaactataactgtacaaaatcggctggatcataatgagactttgggtgaggtcctcccgcatcagcatgtggcggtagaacgaggtctcgtctggggagttgttgaaaacttggaggaattgggagcggcgcaaatggtacat

SEQ ID NO: 874 - DNA, 42 bp, Artificial Sequence
  synthetic oligo
gcgtaatacgactcactataggatgtaccatttgcgccgctc

SEQ ID NO: 875 - DNA, 25 bp, Artificial Sequence
  synthetic oligo
atgtcctggtacttgaggttcctcc

SEQ ID NO: 876 - DNA, 20 bp, Artificial Sequence
  synthetic oligo
atgtaccatttgcgccgctc

SEQ ID NO: 877 - DNA, 47 bp, Artificial Sequence
  synthetic oligo
gcgtaatacgactcactataggatgtcctggtacttgaggttcctcc

SEQ ID NO: 878 - DNA, 526 bp, Tribolium castaneum
caacagcgcttgaagatcatggaatattacgagaagaaggagaaaccggtggaattgcagaagaaaattcagtcgtcaaacatgctgaaccaagcccgtttgaaagtattaaaagtgcgtgaagaccacgtccacaatgtgctggatgacgcccgcaaacgtctgggcgaaatcaccaatgaccaggcgagatattcacaacttttggagtctcttatcctccagagtctctaccagtacttgggaatcagtgatgagttgtttgagaacaatatagtggtgagagtcaggcaacaggacaggagtataatccagggcattctcccagttgttgcgacgaaatacagggacgccactggtaaagacgttcatcttaaaatcgacgatgagagccacttgccatccgaaaccaccggaggagtggttttgtatgcgcaaaagggtaaaatcaagattgacaacaccttggaggctcgtttggatttaattgcacagcaacttgtgccagaaattcgtacggccttgt

SEQ ID NO: 879 - DNA, 44 bp, Artificial Sequence
  synthetic oligo
gcgtaatacgactcactataggcaacagcgcttgaagatcatgg

SEQ ID NO: 880 - DNA, 22 bp, Artificial Sequence
  synthetic oligo
acaaggccgtacgaatttctgg

SEQ ID NO: 881 - DNA, 22 bp, Artificial Sequence
  synthetic oligo
caacagcgcttgaagatcatgg

SEQ ID NO: 882 - DNA, 44 bp, Artificial Sequence
  synthetic oligo
gcgtaatacgactcactataggacaaggccgtacgaatttctgg

SEQ ID NO: 883 - DNA, 687 bp, Tribolium castaneum
cgatacagtgttgctgaaagggaagcggcggaaagagaccgtctgcattgtgctggccgacgaaaactgccccgatgagaagatccggatgaacaggatcgtcaggaataatctacgggttaggctctctgacgtcgtctggatccagccctgtcccgacgtcaaatacgggaagaggatccacgttttgcccatcgatgacacggtcgaagggctcgtcggaaatctcttcgaggtgtacttaaaaccatacttcctcgaagcttatcgaccaatccacaaaggcgacgttttcatcgtccgtggtggcatgcgagccgttgaattcaaagtggtggaaacggaaccgtcaccatattgtatcgtcgcccccgataccgtcatccattgtgacggcgatccgatcaaacgagaagaagaggaggaagccttgaacgccgtcggctacgacgatatcggcggttgtcgcaaacaactcgcacaaatcaaagaaatggtcgaattacctctacgccacccgtcgctcttcaaggccattggcgtgaaaccaccacgtggtatcctcttgtacggacctccaggtaccggtaaaactttaatcgcacgtgcagtggccaacgaaaccggtgctttcttcttcttaatcaacggtcccgaaattatgagtaaattagccggcgaatccga

SEQ ID NO: 884 - DNA, 47 bp, Artificial Sequence
  synthetic oligo
gcgtaatacgactcactataggcgatacagtgttgctgaaagggaag

SEQ ID NO: 885 - DNA, 22 bp, Artificial Sequence
  synthetic oligo
tcggattcgccggctaatttac

SEQ ID NO: 886 - DNA, 25 bp, Artificial Sequence
  synthetic oligo
cgatacagtgttgctgaaagggaag

SEQ ID NO: 887 - DNA, 44 bp, Artificial Sequence
  synthetic oligo
gcgtaatacgactcactataggtcggattcgccggctaatttac

SEQ ID NO: 888 - DNA, 734 bp, Myzus persicae
ggccccaagaagcatttgaagcgtttaaacgcacccaaagcatggatgttggacaaatcggggggtgtcttcgctccacgtccaagcaccggtccacacaaacttcgtgaatcactaccgttattgatcttcttgcgtaatcgtttgaagtatgcacttactggtgccgaagtcaccaagattgtcatgcaaagattaatcaaggttgatggcaaagtccgtaccgaccctaattatccagccggttttatggatgttatatctatccaaaagaccagtgagcactttagattgatctatgatgtgaaaggtcgtttcaccatccacagaattactcctgaagaagcaaaatacaagttgtgtaaagtaaagagggtacaaactggacccaaaggtgtgccatttttaactactcatgatggccgtactattcgctaccctgaccctaacatcaaggttaatgacactattagatacgatattgcatcatctaaaattttggatcatatccgttttgaaactggaaacttgtgcatgataactggaggtcgcaatttagggcgtgttggtattgttaccaacagggaaagacatccaggatcttttgatattgttcacattaaggatgcaaatgaacatatttttgctacccggatgaacaatgtttttattattggaaaaggtcaaaagaactacatttctctaccaaggagtaagggagttaaattgactat

SEQ ID NO: 889 - protein, 244 aa, Myzus persicae
GPKKHLKRLNAPKAWMLDKSGGVFAPRPSTGPHKLRESLPLLIFLRNRLKYALTGAEVTKIVMQRLIKVDGKVRTDPNYPAGFMDVISIQKTSEHFRLIYDVKGRFTIHRITPEEAKYKLCKVKRVQTGPKGVPFLTTHDGRTIRYPDPNIKVNDTIRYDIASSKILDHIRFETGNLCMITGGRNLGRVGIVTNRERHPGSFDIVHIKDANEHIFATRMNNVFIIGKGQKNYISLPRSKGVKLT

SEQ ID NO: 890 - DNA, 396 bp, Myzus persicae
gagtttctttagtaaagtattcggtggcaaaaaggaagagaagggaccatcaaccgaagatgcgatacaaaagcttcgatccactgaagagatgctgataaagaaacaagaatttttagaaaaaaaaattgaacaagaagtagcgatagccaaaaaaaatggtacaactaataaacgagctgcattgcaagcattgaagcgtaagaaacggtacgaacaacaattagcccaaattgatggtaccatgttaactattgaacaacagcgggaggcattagaaggtgccaacacaaatacagcagtattgactaccatgaaaactgcagcagatgcacttaaatcagctcatcaaaacatgaatgtagatgatgtacatgatctgatggatgacattgc

SEQ ID NO: 891 - protein, 131 aa, Myzus persicae
SFFSKVFGGKKEEKGPSTEDAIQKLRSTEEMLIKKQEFLEKKIEQEVAIAKKNGTTNKRAALQALKRKKRYEQQLAQIDGTMLTIEQQREALEGANTNTAVLTTMKTAADALKSAHQNMNVDDVHDLMDDI

SEQ ID NO: 892 - DNA, 845 bp, Myzus persicae
gtggctgcatacagttcattacgcagtatcaacattccagtggctataaacgaattagagtcaccacattagctaggaattgggcagaccctgttcagaatatgatgcatgttagtgctgcatttgatcaagaagcatctgccgttttaatggctcgtatggtagtgaaccgtgctgaaactgaggatagtccagatgtgatgcgttgggctgatcgtacgcttatacgcttgtgtcaaaaatttggtgattatcaaaaagatgatccaaatagtttccgattgccagaaaacttcagtttatatccacagttcatgtatcatttaagaaggtctcaatttctacaagtttttaataatagtcctgatgaaacatcatattataggcacatgttgatgcgtgaagatgttacccaaagtttaatcatgatacagccaattctgtatagctatagttttaatggtaggccagaacctgtacttttggataccagtagtattcaacctgataaaatattattgatggacacatttttccatattttgatattccatggagagactattgctcaatggagagcaatggattatcaaaatagaccagagtatagtaacctcaagcagttgcttcaagcccccgttgatgatgctcaggaaattctcaaaactcgattcccaatgcctcggtatattgacacagaacaaggtggtagtcaggcaagatttttactatgcaaagtaaacccatctcaaacacataataatatgtatgcttatggagggtgatggtggagcaccagttttgacagatgatgtaagcttgcagctgttcatggagcagccgcg

SEQ ID NO: 893 - protein, 279 aa, Myzus persicae
GCIQFITQYQHSSGYKRIRVTTLARNWADPVQNMMHVSAAFDQEASAVLMARMVVNRAETEDSPDVMRWADRTLIRLCQKFGDYQKDDPNSFRLPENFSLYPQFMYHLRRSQFLQVFNNSPDETSYYRHMLMREDVTQSLIMIQPILYSYSFNGRPEPVLLDTSSIQPDKILLMDTFFHILIFHGETIAQWRAMDYQNRPEYSNLKQLLQAPVDDAQEILKTRFPMPRYIDTEQGGSQARFLLCKVNPSQTHNNMYAYGGWWSTSFDRCKLAAVHGAAA

SEQ ID NO: 894 - DNA, 734 bp, Myzus persicae
gtgtcggaggatatgttgggccgcgttttcaatggcagtggaaagccgatagataaaggacctcctattttggctgaagattatttggatattgaaggccaacctattaatccatactccagaacatatcctcaagaaatgattcaaactggtatttcagctattgatatcatgaactctattgctcgtggacaaaaaattccaatattttcagctgcaggtttaccacataatgagattgctgctcaaatttgtagacaagctggtctcgttaaaaaacctggtaaatcagttcttgacgatcatgaagacaattttgctatagtatttgctgctatgggtgttaatatggaaacagccagattctttaaacaagattttgaggaaaatggttcaatggagaatgtttgtttgttcttgaatttagctaatgatcctactattgagcgtatcattacaccacgtcttgctttaactgctgctgaatttttagcttaccaatgtgaaaagcatgtcttagttattttaactgacatgagttcatatgctgaagctttaagagaagtttctgctgctcgtgaagaagtacctgggcgtcgtggtttccctggttacatgtacaccgatttagctacaatttatgaacgtgctgggcgtgtagaaggaagaaatggttctatcacacaaatacctattttaactatgcctaacgacgacatcacccatcctattcc

SEQ ID NO: 895 - protein, 244 aa, Myzus persicae
VSEDMLGRVFNGSGKPIDKGPPILAEDYLDIEGQPINPYSRTYPQEMIQTGISAIDIMNSIARGQKIPIFSAAGLPHNEIAAQICRQAGLVKKPGKSVLDDHEDNFAIVFAAMGVNMETARFFKQDFEENGSMENVCLFLNLANDPTIERIITPRLALTAAEFLAYQCEKHVLVILTDMSSYAEALREVSAAREEVPGRRGFPGYMYTDLATIYERAGRVEGRNGSITQIPILTMPNDDITHPI

SEQ ID NO: 896 - DNA, 1041 bp, Myzus persicae
cgccgattaccaaaacaagacgtgtgttcagacattagaaggccatgctcaaaatatttctgctcgtttgtttccatccagaacttcccatcgtgttaactggctcagaagatggtaccgtcagaatttggcattctggtacttatcgattagaatcatcattaaactatgggttagaacgtgtatggacaatctgttgcttacggggatctaataatgtagctctaggttatgatgaaggaagtataatggttaaagttggtcgtgaagagccagcaatgtcaatggatgttcatgggggtaaaattgtttgggcacgtcatagtgaaattcaacaagctaaccttaaagcgatgcttcaagcagaaggagccgaaatcaaagatggtgaacgtttaccaatacaagttaaagacatgggtagctgtgaaatttatccacagtcaatatctcataatccgaatggtagatttttagtagtatgtggtgatggagagtatattatatatacatcaatggctttgcgtaataaagcatttggctccgctcaggattttgtatggtcttctgattctgagtatgccattagagaaaattcttctacaatcaaagtttttaaaaattttaaagaaaaaaagtcttttaaaccagaaggtggagcagatggtatttttggaggttatttgttaggtgtgaaatctgttactgggttggctttatatgattgggaaaatggtaacttagttcgaagaattgagacacaacctaaacatgtattttggtcagagtctggagaattagtatgtcttgccacagatgaagcatactttattttacgttttgacgtcaatgtacttagtgctgcaagagcatccaattatgaagctgctagtcctgatggtcttgaagatgcctttgagattttaggagaagttcaagaagttgtaaaaactggtctatgggttggtgattgctttatttacaccaatggagtaaatcgtatcaactattatgttggtggtgaagttgtgacagtatccc

SEQ ID NO: 897 - protein, 345 aa, Myzus persicae
PITKTRRVFRHKAMLKIFLLVCFHPELPIVLTGSEDGTVRIWHSGTYRLESSLNYGLERVWTICCLRGSNNVALGYDEGSIMVKVGREEPAMSMDVHGGKIVWARHSEIQQANLKAMLQAEGAEIKDGERLPIQVKDMGSCEIYPQSISHNPNGRFLVVCGDGEYIIYTSMALRNKAFGSAQDFVWSSDSEYAIRENSSTIKVFKNFKEKKSFKPEGGADGIFGGYLLGVKSVTGLALYDWENGNLVRRIETQPKHVFWSESGELVCLATDEAYFILRFDVNVLSAARASNYEAASPDGLEDAFEILGEVQEVVKTGLWVGDCFIYTNGVNRINYYVGGEVVTVS

SEQ ID NO: 898 - DNA, 23 bp, Artificial Sequence
  synthetic oligo
ggccccaagaagcatttgaagcg

SEQ ID NO: 899 - DNA, 23 bp, Artificial Sequence
  synthetic oligo
  misc_feature (18)..(18): n is a, c, g, or t
cgcttgtcccgctcctcngcrat

SEQ ID NO: 900 - DNA, 27 bp, Artificial Sequence
  synthetic oligo
gagtttctttagtaaagtattcggtgg

SEQ ID NO: 901 - DNA, 26 bp, Artificial Sequence
  synthetic oligo
gcaatgtcatccatcakrtcrtgtac

SEQ ID NO: 902 - DNA, 26 bp, Artificial Sequence
  synthetic oligo
gtggctgcatacagttcattacgcag

SEQ ID NO: 903 - DNA, 23 bp, Artificial Sequence
  synthetic oligo
cgcggctgctccatgaayasytg

SEQ ID NO: 904 - DNA, 23 bp, Artificial Sequence
  synthetic oligo
gtgtcggaggatatgytgggycg

SEQ ID NO: 905 - DNA, 24 bp, Artificial Sequence
  synthetic oligo
ggaataggatgggtratrtcgtcg

SEQ ID NO: 906 - DNA, 24 bp, Artificial Sequence
  synthetic oligo
cgccgattaccaaaacaaracbtg

SEQ ID NO: 907 - DNA, 25 bp, Artificial Sequence
  synthetic oligo
gggatactgtcacaayytcdccrcc

SEQ ID NO: 908 - DNA, 21 bp, Myzus persicae
aaagcatggatgttggacaaa

SEQ ID NO: 909 - DNA, 22 bp, Myzus persicae
aaagcatggatgttggacaaat

SEQ ID NO: 910 - DNA, 29 bp, Myzus persicae
aagaagcatttgaagcgtttaaacgcacc

SEQ ID NO: 911 - DNA, 23 bp, Myzus persicae
aagcatttgaagcgtttaaacgc

SEQ ID NO: 912 - DNA, 26 bp, Myzus persicae
aagcatttgaagcgtttaaacgcacc

SEQ ID NO: 913 - DNA, 28 bp, Myzus persicae
aagtccgtaccgaccctaattatccagc

SEQ ID NO: 914 - DNA, 22 bp, Myzus persicae
acgcacccaaagcatggatgtt

SEQ ID NO: 915 - DNA, 21 bp, Myzus persicae
actattagatacgatattgca

SEQ ID NO: 916 - DNA, 50 bp, Myzus persicae
actggacccaaaggtgtgccatttttaactactcatgatggccgtactat

SEQ ID NO: 917 - DNA, 22 bp, Myzus persicae
agaagcatttgaagcgtttaaa

SEQ ID NO: 918 - DNA, 28 bp, Myzus persicae
agaagcatttgaagcgtttaaacgcacc

SEQ ID NO: 919 - DNA, 51 bp, Myzus persicae
agaagcatttgaagcgtttaaacgcacccaaagcatggatgttggacaaat

SEQ ID NO: 920 - DNA, 22 bp, Myzus persicae
agtaagggagttaaattgacta

SEQ ID NO: 921 - DNA, 22 bp, Myzus persicae
atacaagttgtgtaaagtaaag

SEQ ID NO: 922 - DNA, 71 bp, Myzus persicae
atggatgttatatctatccaaaagaccagtgagcactttagattgatctatgatgtgaaaggtcgtttcac

SEQ ID NO: 923 - DNA, 30 bp, Myzus persicae
attgatctatgatgtgaaaggtcgtttcac

SEQ ID NO: 924 - DNA, 29 bp, Myzus persicae
caaaagaccagtgagcactttagattgat

SEQ ID NO: 925 - DNA, 23 bp, Myzus persicae
cacagaattactcctgaagaagc

SEQ ID NO: 926 - DNA, 33 bp, Myzus persicae
cacagaattactcctgaagaagcaaaatacaag

SEQ ID NO: 927 - DNA, 32 bp, Myzus persicae
catccaggatcttttgatattgttcacattaa

SEQ ID NO: 928 - DNA, 59 bp, Myzus persicae
catccaggatcttttgatattgttcacattaaggatgcaaatgaacatatttttgctac

SEQ ID NO: 929 - DNA, 52 bp, Myzus persicae
catctaaaattttggatcatatccgttttgaaactggaaacttgtgcatgat

SEQ ID NO: 930 - DNA, 23 bp, Myzus persicae
catttgaagcgtttaaacgcacc

SEQ ID NO: 931 - DNA, 38 bp, Myzus persicae
catttgaagcgtttaaacgcacccaaagcatggatgtt

SEQ ID NO: 932 - DNA, 22 bp, Myzus persicae
ccaaagcatggatgttggacaa

SEQ ID NO: 933 - DNA, 28 bp, Myzus persicae
ccaaggagtaagggagttaaattgacta

SEQ ID NO: 934 - DNA, 21 bp, Myzus persicae
cccaaagcatggatgttggac

SEQ ID NO: 935 - DNA, 23 bp, Myzus persicae
cccaaagcatggatgttggacaa

SEQ ID NO: 936 - DNA, 24 bp, Myzus persicae
cccaaagcatggatgttggacaaa

SEQ ID NO: 937 - DNA, 25 bp, Myzus persicae
cccaaagcatggatgttggacaaat

SEQ ID NO: 938 - DNA, 26 bp, Myzus persicae
cgtccaagcaccggtccacacaaact

SEQ ID NO: 939 - DNA, 28 bp, Myzus persicae
ctggaaacttgtgcatgataactggagg

SEQ ID NO: 940 - DNA, 125 bp, Myzus persicae
gaaagacatccaggatcttttgatattgttcacattaaggatgcaaatgaacatatttttgctacccggatgaacaatgtttttattattggaaaaggtcaaaagaactacatttctctaccaag

SEQ ID NO: 941 - DNA, 38 bp, Myzus persicae
gatcatatccgttttgaaactggaaacttgtgcatgat

SEQ ID NO: 942 - DNA, 26 bp, Myzus persicae
gatgcaaatgaacatatttttgctac

SEQ ID NO: 943 - DNA, 23 bp, Myzus persicae
gcacccaaagcatggatgttgga

SEQ ID NO: 944 - DNA, 28 bp, Myzus persicae
gcacccaaagcatggatgttggacaaat

SEQ ID NO: 945 - DNA, 23 bp, Myzus persicae
ggatcttttgatattgttcacat

SEQ ID NO: 946 - DNA, 53 bp, Myzus persicae
ggatcttttgatattgttcacattaaggatgcaaatgaacatatttttgctac

SEQ ID NO: 947 - DNA, 28 bp, Myzus persicae
ggccccaagaagcatttgaagcgtttaa

SEQ ID NO: 948 - DNA, 26 bp, Myzus persicae
gggcgtgttggtattgttaccaacag

SEQ ID NO: 949 - DNA, 32 bp, Myzus persicae
gggcgtgttggtattgttaccaacagggaaag

SEQ ID NO: 950 - DNA, 21 bp, Myzus persicae
ggtacaaactggacccaaagg

SEQ ID NO: 951 - DNA, 41 bp, Myzus persicae
gtttttattattggaaaaggtcaaaagaactacatttctct

SEQ ID NO: 952 - DNA, 22 bp, Myzus persicae
tgaagtatgcacttactggtgc

SEQ ID NO: 953 - DNA, 38 bp, Myzus persicae
tgtaaagtaaagagggtacaaactggacccaaaggtgt

SEQ ID NO: 954 - DNA, 40 bp, Myzus persicae
tgtgtaaagtaaagagggtacaaactggacccaaaggtgt

SEQ ID NO: 955 - DNA, 113 bp, Myzus persicae
ttcttgcgtaatcgtttgaagtatgcacttactggtgccgaagtcaccaagattgtcatgcaaagattaatcaaggttgatggcaaagtccgtaccgaccctaattatccagc

SEQ ID NO: 956 - DNA, 31 bp, Myzus persicae
ttggaaaaggtcaaaagaactacatttctct

SEQ ID NO: 957 - DNA, 41 bp, Myzus persicae
ttggatcatatccgttttgaaactggaaacttgtgcatgat

SEQ ID NO: 958 - DNA, 41 bp, Myzus persicae
aaaaaaaatggtacaactaataaacgagctgcattgcaagc

SEQ ID NO: 959 - DNA, 21 bp, Myzus persicae
aagaaacggtacgaacaacaa

SEQ ID NO: 960 - DNA, 45 bp, Myzus persicae
acaagaatttttagaaaaaaaaattgaacaagaagtagcgatagc

SEQ ID NO: 961 - DNA, 38 bp, Myzus persicae
caaattgatggtaccatgttaactattgaacaacagcg

SEQ ID NO: 962 - DNA, 29 bp, Myzus persicae
gaagatgcgatacaaaagcttcgatccac

SEQ ID NO: 963 - DNA, 27 bp, Myzus persicae
gagtttctttagtaaagtattcggtgg

SEQ ID NO: 964 - DNA, 21 bp, Myzus persicae
aaaagatgatccaaatagttt

SEQ ID NO: 965 - DNA, 44 bp, Myzus persicae
aaaatattattgatggacacatttttccatattttgatattcca

SEQ ID NO: 966 - DNA, 29 bp, Myzus persicae
aatagtcctgatgaaacatcatattatag

SEQ ID NO: 967 - DNA, 101 bp, Myzus persicae
caaaaagatgatccaaatagtttccgattgccagaaaacttcagtttatatccacagttcatgtatcatttaagaaggtctcaatttctacaagtttttaa

SEQ ID NO: 968 - DNA, 26 bp, Myzus persicae
caacattccagtggctataaacgaat

SEQ ID NO: 969 - DNA, 26 bp, Myzus persicae
cacatgttgatgcgtgaagatgttac

SEQ ID NO: 970 - DNA, 59 bp, Myzus persicae
ccaattctgtatagctatagttttaatggtaggccagaacctgtacttttggataccag

SEQ ID NO: 971 - DNA, 38 bp, Myzus persicae
ccatctcaaacacataataatatgtatgcttatggagg

SEQ ID NO: 972 - DNA, 80 bp, Myzus persicae
ctcaaaactcgattcccaatgcctcggtatattgacacagaacaaggtggtagtcaggcaagatttttactatgcaaagt

SEQ ID NO: 973 - DNA, 44 bp, Myzus persicae
ggtgatggtggagcaccagttttgacagatgatgtaagcttgca

SEQ ID NO: 974 - DNA, 28 bp, Myzus persicae
gtggctgcatacagttcattacgcagta

SEQ ID NO: 975 - DNA, 37 bp, Myzus persicae
taatggctcgtatggtagtgaaccgtgctgaaactga

SEQ ID NO: 976 - DNA, 27 bp, Myzus persicae
tataggcacatgttgatgcgtgaagat

SEQ ID NO: 977 - DNA, 32 bp, Myzus persicae
tgggctgatcgtacgcttatacgcttgtgtca

SEQ ID NO: 978 - DNA, 26 bp, Myzus persicae
ttagctaggaattgggcagaccctgt

SEQ ID NO: 979 - DNA, 23 bp, Myzus persicae
aaacaagattttgaggaaaatgg

SEQ ID NO: 980 - DNA, 22 bp, Myzus persicae
aacctggtaaatcagttcttga

SEQ ID NO: 981 - DNA, 25 bp, Myzus persicae
aacgacgacatcacccatcctattc

SEQ ID NO: 982 - DNA, 26 bp, Myzus persicae
aatttagctaatgatcctactattga

SEQ ID NO: 983 - DNA, 29 bp, Myzus persicae
actatgcctaacgacgacatcacccatcc

SEQ ID NO: 984 - DNA, 35 bp, Myzus persicae
atagtatttgctgctatgggtgttaatatggaaac

SEQ ID NO: 985 - DNA, 23 bp, Myzus persicae
caaatttgtagacaagctggtct

SEQ ID NO: 986 - DNA, 53 bp, Myzus persicae
catgaagacaattttgctatagtatttgctgctatgggtgttaatatggaaac

SEQ ID NO: 987 - DNA, 71 bp, Myzus persicae
ccgatagataaaggacctcctattttggctgaagattatttggatattgaaggccaacctattaatccata

SEQ ID NO: 988 - DNA, 21 bp, Myzus persicae
cctattttggctgaagattat

SEQ ID NO: 989 - DNA, 50 bp, Myzus persicae
cgtatcattacaccacgtcttgctttaactgctgctgaatttttagctta

SEQ ID NO: 990 - DNA, 35 bp, Myzus persicae
cgtcttgctttaactgctgctgaatttttagctta

SEQ ID NO: 991 - DNA, 44 bp, Myzus persicae
gaagaagtacctgggcgtcgtggtttccctggttacatgtacac

SEQ ID NO: 992 - DNA, 50 bp, Myzus persicae
gaaggaagaaatggttctatcacacaaatacctattttaactatgcctaa

SEQ ID NO: 993 - DNA, 53 bp, Myzus persicae
gaaggaagaaatggttctatcacacaaatacctattttaactatgcctaacga

SEQ ID NO: 994 - DNA, 23 bp, Myzus persicae
gatttagctacaatttatgaacg

SEQ ID NO: 995 - DNA, 35 bp, Myzus persicae
gccagattctttaaacaagattttgaggaaaatgg

SEQ ID NO: 996 - DNA, 23 bp, Myzus persicae
gctatgggtgttaatatggaaac

SEQ ID NO: 997 - DNA, 41 bp, Myzus persicae
gctgcaggtttaccacataatgagattgctgctcaaatttg

SEQ ID NO: 998 - DNA, 65 bp, Myzus persicae
gctgggcgtgtagaaggaagaaatggttctatcacacaaatacctattttaactatgcctaacga

SEQ ID NO: 999 - DNA, 38 bp, Myzus persicae
ggttacatgtacaccgatttagctacaatttatgaacg

SEQ ID NO: 1000 - DNA, 25 bp, Myzus persicae
gtggacaaaaaattccaatattttc

SEQ ID NO: 1001 - DNA, 23 bp, Myzus persicae
gtgtcggaggatatgttgggccg

SEQ ID NO: 1002 - DNA, 33 bp, Myzus persicae
gttcttgaatttagctaatgatcctactattga

SEQ ID NO: 1003 - DNA, 53 bp, Myzus persicae
tcaatggagaatgtttgtttgttcttgaatttagctaatgatcctactattga

SEQ ID NO: 1004 - DNA, 56 bp, Myzus persicae
tcagctattgatatcatgaactctattgctcgtggacaaaaaattccaatattttc

SEQ ID NO: 1005 - DNA, 38 bp, Myzus persicae
tcatatgctgaagctttaagagaagtttctgctgctcg

SEQ ID NO: 1006 - DNA, 38 bp, Myzus persicae
tccagaacatatcctcaagaaatgattcaaactggtat

SEQ ID NO: 1007 - DNA, 26 bp, Myzus persicae
tctattgctcgtggacaaaaaattcc

SEQ ID NO: 1008 - DNA, 107 bp, Myzus persicae
tgtgaaaagcatgtcttagttattttaactgacatgagttcatatgctgaagctttaagagaagtttctgctgctcgtgaagaagtacctgggcgtcgtggtttccc

SEQ ID NO: 1009 - DNA, 68 bp, Myzus persicae
ttaactgacatgagttcatatgctgaagctttaagagaagtttctgctgctcgtgaagaagtacctgg

SEQ ID NO: 1010 - DNA, 25 bp, Myzus persicae
tttttaaaaattttaaagaaaaaaa

SEQ ID NO: 1011 - DNA, 25 bp, Myzus persicae
gatcttttgatattgttcacattaa

SEQ ID NO: 1012 - DNA, 28 bp, Myzus persicae
acatccaggatcttttgatattgttcac

SEQ ID NO: 1013 - DNA, 23 bp, Myzus persicae
tcttttgatattgttcacattaa

SEQ ID NO: 1014 - DNA, 21 bp, Myzus persicae
tattgctcgtggacaaaaaat

SEQ ID NO: 1015 - DNA, 26 bp, Myzus persicae
tctgctgctcgtgaagaagtacctgg

SEQ ID NO: 1016 - DNA, 21 bp, Myzus persicae
gctgaagattatttggatatt

SEQ ID NO: 1017 - DNA, 26 bp, Myzus persicae
ggtttaccacataatgagattgctgc

SEQ ID NO: 1018 - DNA, 35 bp, Myzus persicae
aagaaatgattcaaactggtatttcagctattgat

SEQ ID NO: 1019 - DNA, 27 bp, Myzus persicae
tattgctcgtggacaaaaaattccaat

SEQ ID NO: 1020 - DNA, 23 bp, Myzus persicae
gtttctgctgctcgtgaagaagt

SEQ ID NO: 1021 - DNA, 26 bp, Myzus persicae
cgtggtttccctggttacatgtacac

SEQ ID NO: 1022 - DNA, 23 bp, Myzus persicae
cctggttacatgtacaccgattt

SEQ ID NO: 1023 - DNA, 21 bp, Myzus persicae
tttaaaaattttaaagaaaaa

SEQ ID NO: 1024 - DNA, 24 bp, Myzus persicae
ctattatgttggtggtgaagttgt

SEQ ID NO: 1025 - DNA, 21 bp, Myzus persicae
aaagtttttaaaaattttaaa

SEQ ID NO: 1026 - DNA, 21 bp, Myzus persicae
aatttttagaaaaaaaaattg

SEQ ID NO: 1027 - DNA, 21 bp, Myzus persicae
gtcaccacattagctaggaat

SEQ ID NO: 1028 - DNA, 22 bp, Myzus persicae
aagaaatgattcaaactggtat

SEQ ID NO: 1029 - DNA, 25 bp, Myzus persicae
aagaaatgattcaaactggtatttc

SEQ ID NO: 1030 - DNA, 21 bp, Myzus persicae
catgaactctattgctcgtgg

SEQ ID NO: 1031 - DNA, 23 bp, Myzus persicae
gctgctatgggtgttaatatgga

SEQ ID NO: 1032 - DNA, 24 bp, Myzus persicae
tgctatgggtgttaatatggaaac

SEQ ID NO: 1033 - DNA, 23 bp, Myzus persicae
cctactattgagcgtatcattac

SEQ ID NO: 1034 - DNA, 32 bp, Myzus persicae
gaagtttctgctgctcgtgaagaagtacctgg

SEQ ID NO: 1035 - DNA, 23 bp, Myzus persicae
gtttctgctgctcgtgaagaagt

SEQ ID NO: 1036 - DNA, 26 bp, Myzus persicae
gtgtacatgtaaccagggaaaccacg

SEQ ID NO: 1037 - DNA, 23 bp, Myzus persicae
cctggttacatgtacaccgattt

SEQ ID NO: 1038 - DNA, 21 bp, Myzus persicae
ggttacatgtacaccgattta

SEQ ID NO: 1039 - DNA, 23 bp, Myzus persicae
cctattttaactatgcctaacga

SEQ ID NO: 1040 - DNA, 21 bp, Myzus persicae
actctccatcaccacatacta

SEQ ID NO: 1041 - DNA, 552 bp, Myzus persicae
gtttaaacgcacccaaagcatggatgttggacaaatcggggggtgtcttcgctccacgtccaagcaccggtccacacaaacttcgtgaatcactaccgttattgatcttcttgcgtaatcgtttgaagtatgcacttactggtgccgaagtcaccaagattgtcatgcaaagattaatcaaggttgatggcaaagtccgtaccgaccctaattatccagccggttttatggatgttatatctatccaaaagaccagtgagcactttagattgatctatgatgtgaaaggtcgtttcaccatccacagaattactcctgaagaagcaaaatacaagttgtgtaaagtaaagagggtacaaactggacccaaaggtgtgccatttttaactactcatgatggccgtactattcgctaccctgaccctaacatcaaggttaatgacactattagatacgatattgcatcatctaaaattttggatcatatccgttttgaaactggaaacttgtgcatgataactggaggtcgcaatttagggcgtgttggtattg

SEQ ID NO: 1042 - DNA, 45 bp, Artificial Sequence
  synthetic oligo
gcgtaatacgactcactatagggtttaaacgcacccaaagcatgg

SEQ ID NO: 1043 - DNA, 24 bp, Artificial Sequence
  synthetic oligo
caataccaacacgccctaaattgc

SEQ ID NO: 1044 - DNA, 23 bp, Artificial Sequence
  synthetic oligo
gtttaaacgcacccaaagcatgg

SEQ ID NO: 1045 - DNA, 46 bp, Artificial Sequence
  synthetic oligo
gcgtaatacgactcactataggcaataccaacacgccctaaattgc

SEQ ID NO: 1046 - DNA, 323 bp, Myzus persicae
ggtggcaaaaaggaagagaagggaccatcaaccgaagatgcgatacaaaagcttcgatccactgaagagatgctgataaagaaacaagaatttttagaaaaaaaaattgaacaagaagtagcgatagccaaaaaaaatggtacaactaataaacgagctgcattgcaagcattgaagcgtaagaaacggtacgaacaacaattagcccaaattgatggtaccatgttaactattgaacaacagcgggaggcattagaaggtgccaacacaaatacagcagtattgactaccatgaaaactgcagcagatgcacttaaatcagc

SEQ ID NO: 1047 - DNA, 44 bp, Artificial Sequence
  synthetic oligo
gcgtaatacgactcactataggggtggcaaaaaggaagagaagg

SEQ ID NO: 1048 - DNA, 23 bp, Artificial Sequence
  synthetic oligo
gctgatttaagtgcatctgctgc

SEQ ID NO: 1049 - DNA, 22 bp, Artificial Sequence
  synthetic oligo
ggtggcaaaaaggaagagaagg

SEQ ID NO: 1050 - DNA, 45 bp, Artificial Sequence
  synthetic oligo
gcgtaatacgactcactatagggctgatttaagtgcatctgctgc

SEQ ID NO: 1051 - DNA, 597 bp, Myzus persicae
cagaccctgttcagaatatgatgcatgttagtgctgcatttgatcaagaagcatctgccgttttaatggctcgtatggtagtgaaccgtgctgaaactgaggatagtccagatgtgatgcgttgggctgatcgtacgcttatacgcttgtgtcaaaaatttggtgattatcaaaaagatgatccaaatagtttccgattgccagaaaacttcagtttatatccacagttcatgtatcatttaagaaggtctcaatttctacaagtttttaataatagtcctgatgaaacatcatattataggcacatgttgatgcgtgaagatgttacccaaagtttaatcatgatacagccaattctgtatagctatagttttaatggtaggccagaacctgtacttttggataccagtagtattcaacctgataaaatattattgatggacacatttttccatattttgatattccatggagagactattgctcaatggagagcaatggattatcaaaatagaccagagtatagtaacctcaagcagttgcttcaagcccccgttgatgatgctcaggaaattctcaaaactcgattcccaatgc

SEQ ID NO: 1052 - DNA, 42 bp, Artificial Sequence
  synthetic oligo
gcgtaatacgactcactataggcagaccctgttcagaatatg

SEQ ID NO: 1053 - DNA, 22 bp, Artificial Sequence
  synthetic oligo
gcattgggaatcgagttttgag

SEQ ID NO: 1054 - DNA, 20 bp, Artificial Sequence
  synthetic oligo
cagaccctgttcagaatatg

SEQ ID NO: 1055 - DNA, 44 bp, Artificial Sequence
  synthetic oligo
gcgtaatacgactcactatagggcattgggaatcgagttttgag

SEQ ID NO: 1056 - DNA, 440 bp, Myzus persicae
gttttcaatggcagtggaaagccgatagataaaggacctcctattttggctgaagattatttggatattgaaggccaacctattaatccatactccagaacatatcctcaagaaatgattcaaactggtatttcagctattgatatcatgaactctattgctcgtggacaaaaaattccaatattttcagctgcaggtttaccacataatgagattgctgctcaaatttgtagacaagctggtctcgttaaaaaacctggtaaatcagttcttgacgatcatgaagacaattttgctatagtatttgctgctatgggtgttaatatggaaacagccagattctttaaacaagattttgaggaaaatggttcaatggagaatgtttgtttgttcttgaatttagctaatgatcctactattgagcgtatcattacaccacg

SEQ ID NO: 1057 - DNA, 44 bp, Artificial Sequence
  synthetic oligo
gcgtaatacgactcactatagggttttcaatggcagtggaaagc

SEQ ID NO: 1058 - DNA, 20 bp, Artificial Sequence
  synthetic oligo
cgtggtgtaatgatacgctc

SEQ ID NO: 1059 - DNA, 22 bp, Artificial Sequence
  synthetic oligo
gttttcaatggcagtggaaagc

SEQ ID NO: 1060 - DNA, 42 bp, Artificial Sequence
  synthetic oligo
gcgtaatacgactcactataggcgtggtgtaatgatacgctc

SEQ ID NO: 1061 - DNA, 615 bp, Myzus persicae
gctcgtttgtttccatccagaacttcccatcgtgttaactggctcagaagatggtaccgtcagaatttggcattctggtacttatcgattagaatcatcattaaactatgggttagaacgtgtatggacaatctgttgcttacggggatctaataatgtagctctaggttatgatgaaggaagtataatggttaaagttggtcgtgaagagccagcaatgtcaatggatgttcatgggggtaaaattgtttgggcacgtcatagtgaaattcaacaagctaaccttaaagcgatgcttcaagcagaaggagccgaaatcaaagatggtgaacgtttaccaatacaagttaaagacatgggtagctgtgaaatttatccacagtcaatatctcataatccgaatggtagatttttagtagtatgtggtgatggagagtatattatatatacatcaatggctttgcgtaataaagcatttggctccgctcaggattttgtatggtcttctgattctgagtatgccattagagaaaattcttctacaatcaaagtttttaaaaattttaaagaaaaaaagtcttttaaaccagaaggtggagcagatggtatttttgg

SEQ ID NO: 1062 - DNA, 45 bp, Artificial Sequence
  synthetic oligo
gcgtaatacgactcactatagggctcgtttgtttccatccagaac

SEQ ID NO: 1063 - DNA, 23 bp, Artificial Sequence
  synthetic oligo
ccaaaaataccatctgctccacc

SEQ ID NO: 1064 - DNA, 23 bp, Artificial Sequence
  synthetic oligo
gctcgtttgtttccatccagaac

SEQ ID NO: 1065 - DNA, 45 bp, Artificial Sequence
  synthetic oligo
gcgtaatacgactcactataggccaaaaataccatctgctccacc

SEQ ID NO: 1066 - DNA, 2616 bp, Myzus persicae
gtttaaacgcacccaaagcatggatgttggacaaatcggggggtgtcttcgctccacgtccaagcaccggtccacacaaacttcgtgaatcactaccgttattgatcttcttgcgtaatcgtttgaagtatgcacttactggtgccgaagtcaccaagattgtcatgcaaagattaatcaaggttgatggcaaagtccgtaccgaccctaattatccagccggttttatggatgttatatctatccaaaagaccagtgagcactttagattgatctatgatgtgaaaggtcgtttcaccatccacagaattactcctgaagaagcaaaatacaagttgtgtaaagtaaagagggtacaaactggacccaaaggtgtgccatttttaactactcatgatggccgtactattcgctaccctgaccctaacatcaaggttaatgacactattagatacgatattgcatcatctaaaattttggatcatatccgttttgaaactggaaacttgtgcatgataactggaggtcgcaatttagggcgtgttggtattgaagggcgaattcgacccagctttcttgtacaaagtggtgatatcactagtgcggccgcctgcaggtcgaccatatggtcgacctgcaggcggccgcactagtgatgctgttatgttcagtgtcaagctgacctgcaaacacgttaaatgctaagaagttagaatatatgagacacgttaactggtatatgaataagctgtaaataaccgagtataaactcattaactaatatcacctctagagtataatataatcaaattcgacaatttgactttcaagagtaggctaatgtaaaatctttatatatttctacaatgttcaaagaaacagttgcatctaaacccctatggccatcaaattcaatgaacgctaagctgatccggcgagattttcaggagctaaggaagctaaaatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaattccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcaccatgggcaaatattatacgcaaggcgacaaggtgctgatgccgctggcgattcaggttcatcatgccgtctgtgatggcttccatgtcggcagaatgcttaatgaattacaacagtactgcgatgagtggcagggcggggcgtaaacgcgtggatcagcttaatatgactctcaataaagtctcataccaacaagtgccaccttattcaaccatcaagaaaaaagccaaaatttatgctactctaaggaaaacttcactaaagaagacgatttagagtgttttaccaagaatttctgtcatcttactaaacaactaaagatcggtgtgatacaaaacctaatctcattaaagtttatgctaaaataagcataattttacccactaagcgtgaccagataaacataactcagcacaccagagcatatatattggtggctcaaatcatagaaacttacagtgaagacacagaaagccgtaagaagaggcaagagtatgaaaccttacctcatcatttccatgaggttgcttctgatcccgcgggatatcaccactttgtacaagaaagctgggtcgaattcgcccttcaataccaacacgccctaaattgcgacctccagttatcatgcacaagtttccagtttcaaaacggatatgatccaaaattttagatgatgcaatatcgtatctaatagtgtcattaaccttgatgttagggtcagggtagcgaatagtacggccatcatgagtagttaaaaatggcacacctttgggtccagtttgtaccctctttactttacacaacttgtattttgcttcttcaggagtaattctgtggatggtgaaacgacctttcacatcatagatcaatctaaagtgctcactggtcttttggatagatataacatccataaaaccggctggataattagggtcggtacggactttgccatcaaccttgattaatctttgcatgacaatcttggtgacttcggcaccagtaagtgcatacttcaaacgattacgcaagaagatcaataacggtagtgattcacgaagtttgtgtggaccggtgcttggacgtggagcgaagacaccccccgatttgtccaacatccatgctttgggtgcgtttaaac

SEQ ID NO: 1067 - DNA, 2158 bp, Myzus persicae
gctgatttaagtgcatctgctgcagttttcatggtagtcaatactgctgtatttgtgttggcaccttctaatgcctcccgctgttgttcaatagttaacatggtaccatcaatttgggctaattgttgttcgtaccgtttcttacgcttcaatgcttgcaatgcagctcgtttattagttgtaccattttttttggctatcgctacttcttgttcaatttttttttctaaaaattcttgtttctttatcagcatctcttcagtggatcgaagcttttgtatcgcatcttcggttgatggtcccttctcttcctttttgccaccaagggcgaattcgacccagctttcttgtacaaagtggtgatatcactagtgcggccgcctgcaggtcgaccatatggtcgacctgcaggcggccgcactagtgatgctgttatgttcagtgtcaagctgacctgcaaacacgttaaatgctaagaagttagaatatatgagacacgttaactggtatatgaataagctgtaaataaccgagtataaactcattaactaatatcacctctagagtataatataatcaaattcgacaatttgactttcaagagtaggctaatgtaaaatctttatatatttctacaatgttcaaagaaacagttgcatctaaacccctatggccatcaaattcaatgaacgctaagctgatccggcgagattttcaggagctaaggaagctaaaatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaattccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcaccatgggcaaatattatacgcaaggcgacaaggtgctgatgccgctggcgattcaggttcatcatgccgtctgtgatggcttccatgtcggcagaatgcttaatgaattacaacagtactgcgatgagtggcagggcggggcgtaaacgcgtggatcagcttaatatgactctcaataaagtctcataccaacaagtgccaccttattcaaccatcaagaaaaaagccaaaatttatgctactctaaggaaaacttcactaaagaagacgatttagagtgttttaccaagaatttctgtcatcttactaaacaactaaagatcggtgtgatacaaaacctaatctcattaaagtttatgctaaaataagcataattttacccactaagcgtgaccagataaacataactcagcacaccagagcatatatattggtggctcaaatcatagaaacttacagtgaagacacagaaagccgtaagaagaggcaagagtatgaaaccttacctcatcatttccatgaggttgcttctgatcccgcgggatatcaccactttgtacaagaaagctgggtcgaattcgcccttggtggcaaaaaggaagagaagggaccatcaaccgaagatgcgatacaaaagcttcgatccactgaagagatgctgataaagaaacaagaatttttagaaaaaaaaattgaacaagaagtagcgatagccaaaaaaaatggtacaactaataaacgagctgcattgcaagcattgaagcgtaagaaacggtacgaacaacaattagcccaaattgatggtaccatgttaactattgaacaacagcgggaggcattagaaggtgccaacacaaatacagcagtattgactaccatgaaaactgcagcagatgcacttaaatcagc

SEQ ID NO: 1068 - DNA, 2706 bp, Myzus persicae
cagaccctgttcagaatatgatgcatgttagtgctgcatttgatcaagaagcatctgccgttttaatggctcgtatggtagtgaaccgtgctgaaactgaggatagtccagatgtgatgcgttgggctgatcgtacgcttatacgcttgtgtcaaaaatttggtgattatcaaaaagatgatccaaatagtttccgattgccagaaaacttcagtttatatccacagttcatgtatcatttaagaaggtctcaatttctacaagtttttaataatagtcctgatgaaacatcatattataggcacatgttgatgcgtgaagatgttacccaaagtttaatcatgatacagccaattctgtatagctatagttttaatggtaggccagaacctgtacttttggataccagtagtattcaacctgataaaatattattgatggacacatttttccatattttgatattccatggagagactattgctcaatggagagcaatggattatcaaaatagaccagagtatagtaacctcaagcagttgcttcaagcccccgttgatgatgctcaggaaattctcaaaactcgattcccaatgcaagggcgaattcgacccagctttcttgtacaaagtggtgatatcactagtgcggccgcctgcaggtcgaccatatggtcgacctgcaggcggccgcactagtgatgctgttatgttcagtgtcaagctgacctgcaaacacgttaaatgctaagaagttagaatatatgagacacgttaactggtatatgaataagctgtaaataaccgagtataaactcattaactaatatcacctctagagtataatataatcaaattcgacaatttgactttcaagagtaggctaatgtaaaatctttatatatttctacaatgttcaaagaaacagttgcatctaaacccctatggccatcaaattcaatgaacgctaagctgatccggcgagattttcaggagctaaggaagctaaaatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaattccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcaccatgggcaaatattatacgcaaggcgacaaggtgctgatgccgctggcgattcaggttcatcatgccgtctgtgatggcttccatgtcggcagaatgcttaatgaattacaacagtactgcgatgagtggcagggcggggcgtaaacgcgtggatcagcttaatatgactctcaataaagtctcataccaacaagtgccaccttattcaaccatcaagaaaaaagccaaaatttatgctactctaaggaaaacttcactaaagaagacgatttagagtgttttaccaagaatttctgtcatcttactaaacaactaaagatcggtgtgatacaaaacctaatctcattaaagtttatgctaaaataagcataattttacccactaagcgtgaccagataaacataactcagcacaccagagcatatatattggtggctcaaatcatagaaacttacagtgaagacacagaaagccgtaagaagaggcaagagtatgaaaccttacctcatcatttccatgaggttgcttctgatcccgcgggatatcaccactttgtacaagaaagctgggtcgaattcgcccttgcattgggaatcgagttttgagaatttcctgagcatcatcaacgggggcttgaagcaactgcttgaggttactatactctggtctattttgataatccattgctctccattgagcaatagtctctccatggaatatcaaaatatggaaaaatgtgtccatcaataatattttatcaggttgaatactactggtatccaaaagtacaggttctggcctaccattaaaactatagctatacagaattggctgtatcatgattaaactttgggtaacatcttcacgcatcaacatgtgcctataatatgatgtttcatcaggactattattaaaaacttgtagaaattgagaccttcttaaatgatacatgaactgtggatataaactgaagttttctggcaatcggaaactatttggatcatctttttgataatcaccaaatttttgacacaagcgtataagcgtacgatcagcccaacgcatcacatctggactatcctcagtttcagcacggttcactaccatacgagccattaaaacggcagatgcttcttgatcaaatgcagcactaacatgcatcatattctgaacagggtctg

SEQ ID NO: 1069 - DNA, 2392 bp, Myzus persicae
gttttcaatggcagtggaaagccgatagataaaggacctcctattttggctgaagattatttggatattgaaggccaacctattaatccatactccagaacatatcctcaagaaatgattcaaactggtatttcagctattgatatcatgaactctattgctcgtggacaaaaaattccaatattttcagctgcaggtttaccacataatgagattgctgctcaaatttgtagacaagctggtctcgttaaaaaacctggtaaatcagttcttgacgatcatgaagacaattttgctatagtatttgctgctatgggtgttaatatggaaacagccagattctttaaacaagattttgaggaaaatggttcaatggagaatgtttgtttgttcttgaatttagctaatgatcctactattgagcgtatcattacaccacgaagggcgaattcgacccagctttcttgtacaaagtggtgatatcactagtgcggccgcctgcaggtcgaccatatggtcgacctgcaggcggccgcactagtgatgctgttatgttcagtgtcaagctgacctgcaaacacgttaaatgctaagaagttagaatatatgagacacgttaactggtatatgaataagctgtaaataaccgagtataaactcattaactaatatcacctctagagtataatataatcaaattcgacaatttgactttcaagagtaggctaatgtaaaatctttatatatttctacaatgttcaaagaaacagttgcatctaaacccctatggccatcaaattcaatgaacgctaagctgatccggcgagattttcaggagctaaggaagctaaaatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaattccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcaccatgggcaaatattatacgcaaggcgacaaggtgctgatgccgctggcgattcaggttcatcatgccgtctgtgatggcttccatgtcggcagaatgcttaatgaattacaacagtactgcgatgagtggcagggcggggcgtaaacgcgtggatcagcttaatatgactctcaataaagtctcataccaacaagtgccaccttattcaaccatcaagaaaaaagccaaaatttatgctactctaaggaaaacttcactaaagaagacgatttagagtgttttaccaagaatttctgtcatcttactaaacaactaaagatcggtgtgatacaaaacctaatctcattaaagtttatgctaaaataagcataattttacccactaagcgtgaccagataaacataactcagcacaccagagcatatatattggtggctcaaatcatagaaacttacagtgaagacacagaaagccgtaagaagaggcaagagtatgaaaccttacctcatcatttccatgaggttgcttctgatcccgcgggatatcaccactttgtacaagaaagctgggtcgaattcgcccttcgtggtgtaatgatacgctcaatagtaggatcattagctaaattcaagaacaaacaaacattctccattgaaccattttcctcaaaatcttgtttaaagaatctggctgtttccatattaacacccatagcagcaaatactatagcaaaattgtcttcatgatcgtcaagaactgatttaccaggttttttaacgagaccagcttgtctacaaatttgagcagcaatctcattatgtggtaaacctgcagctgaaaatattggaattttttgtccacgagcaatagagttcatgatatcaatagctgaaataccagtttgaatcatttcttgaggatatgttctggagtatggattaataggttggccttcaatatccaaataatcttcagccaaaataggaggtcctttatctatcggctttccactgccattgaaaac

SEQ ID NO: 1070 - DNA, 2742 bp, Myzus persicae
ccaaaaataccatctgctccaccttctggtttaaaagactttttttctttaaaatttttaaaaactttgattgtagaagaattttctctaatggcatactcagaatcagaagaccatacaaaatcctgagcggagccaaatgctttattacgcaaagccattgatgtatatataatatactctccatcaccacatactactaaaaatctaccattcggattatgagatattgactgtggataaatttcacagctacccatgtctttaacttgtattggtaaacgttcaccatctttgatttcggctccttctgcttgaagcatcgctttaaggttagcttgttgaatttcactatgacgtgcccaaacaattttacccccatgaacatccattgacattgctggctcttcacgaccaactttaaccattatacttccttcatcataacctagagctacattattagatccccgtaagcaacagattgtccatacacgttctaacccatagtttaatgatgattctaatcgataagtaccagaatgccaaattctgacggtaccatcttctgagccagttaacacgatgggaagttctggatggaaacaaacgagcaagggcgaattcgacccagctttcttgtacaaagtggtgatatcactagtgcggccgcctgcaggtcgaccatatggtcgacctgcaggcggccgcactagtgatgctgttatgttcagtgtcaagctgacctgcaaacacgttaaatgctaagaagttagaatatatgagacacgttaactggtatatgaataagctgtaaataaccgagtataaactcattaactaatatcacctctagagtataatataatcaaattcgacaatttgactttcaagagtaggctaatgtaaaatctttatatatttctacaatgttcaaagaaacagttgcatctaaacccctatggccatcaaattcaatgaacgctaagctgatccggcgagattttcaggagctaaggaagctaaaatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaattccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcaccatgggcaaatattatacgcaaggcgacaaggtgctgatgccgctggcgattcaggttcatcatgccgtctgtgatggcttccatgtcggcagaatgcttaatgaattacaacagtactgcgatgagtggcagggcggggcgtaaacgcgtggatcagcttaatatgactctcaataaagtctcataccaacaagtgccaccttattcaaccatcaagaaaaaagccaaaatttatgctactctaaggaaaacttcactaaagaagacgatttagagtgttttaccaagaatttctgtcatcttactaaacaactaaagatcggtgtgatacaaaacctaatctcattaaagtttatgctaaaataagcataattttacccactaagcgtgaccagataaacataactcagcacaccagagcatatatattggtggctcaaatcatagaaacttacagtgaagacacagaaagccgtaagaagaggcaagagtatgaaaccttacctcatcatttccatgaggttgcttctgatcccgcgggatatcaccactttgtacaagaaagctgggtcgaattcgcccttgctcgtttgtttccatccagaacttcccatcgtgttaactggctcagaagatggtaccgtcagaatttggcattctggtacttatcgattagaatcatcattaaactatgggttagaacgtgtatggacaatctgttgcttacggggatctaataatgtagctctaggttatgatgaaggaagtataatggttaaagttggtcgtgaagagccagcaatgtcaatggatgttcatgggggtaaaattgtttgggcacgtcatagtgaaattcaacaagctaaccttaaagcgatgcttcaagcagaaggagccgaaatcaaagatggtgaacgtttaccaatacaagttaaagacatgggtagctgtgaaatttatccacagtcaatatctcataatccgaatggtagatttttagtagtatgtggtgatggagagtatattatatatacatcaatggctttgcgtaataaagcatttggctccgctcaggattttgtatggtcttctgattctgagtatgccattagagaaaattcttctacaatcaaagtttttaaaaattttaaagaaaaaaagtcttttaaaccagaaggtggagcagatggtatttttgg

SEQ ID NO: 1071 - DNA, 697 bp, Nilaparvata lugens
gaaatcatggatgttggacaaattgggtggtgtgtatgcaccccgacccagcacaggtccacacaagctgcgagaatctctcccacttgtcatatttttgcgtaatcggctcaagtacgctttaactaactgtgaagtgaagaaaattgtgatgcagcgtctcatcaaggttgacggcaaagtgaggactgaccccaactatcctgcaggttttatggacgttgttcaaatcgaaaagacaaacgagttcttccgtttgatctatgatgttaagggacgtttcaccatccacaggatcacagctgaagaagctaagtacaagctgtgcaaagtgaagagggttcagacaggacccaagggcattccatttttgaccactcacgatggacgcaccatcaggtatccagaccccttggtaaaagtcaatgacaccatccaattggacattgccacatccaaaatcatggacttcatcagattcgactctggtaacctgtgtatgatcactggaggtcgtaacttgggtcgtgtgggcactgtcgtgaacagggagcgacacccggggtctttcgacatcgtgcacatcaaggacgtgttgggacacacttttgccactaggttgaacaacgttttcatcatcggcaagggtagtaaagcatacgtgtctctgcccaagggcaagggtgtgaagctcagt

SEQ ID NO: 1072 - protein, 232 aa, Nilaparvata lugens
KSWMLDKLGGVYAPRPSTGPHKLRESLPLVIFLRNRLKYALTNCEVKKIVMQRLIKVDGKVRTDPNYPAGFMDVVQIEKTNEFFRLIYDVKGRFTIHRITAEEAKYKLCKVKRVQTGPKGIPFLTTHDGRTIRYPDPLVKVNDTIQLDIATSKIMDFIRFDSGNLCMITGGRNLGRVGTVVNRERHPGSFDIVHIKDVLGHTFATRLNNVFIIGKGSKAYVSLPKGKGVKLS

SEQ ID NO: 1073 - DNA, 336 bp, Nilaparvata lugens
gatgaaaagggccctacaactggcgaagccattcagaaactacgcgaaacagaggaaatgctgataaagaaacaagactttttagaaaagaaaattgaagttgaaattggagttgccaggaagaatggaacaaaaaacaaaagagccgcgatccaggcactcaaaaggaagaagaggtatgaaaagcaattgcagcagatcgatggaacgttatcaacaattgagatgcagagagaggccctcgaaggagccaacacgaatacggccgtactgcaaactatgaagaacgcagcagatgctctcaaagcggctcatcaacacatggatgtggatcag

SEQ ID NO: 1074 - protein, 112 aa, Nilaparvata lugens
DEKGPTTGEAIQKLRETEEMLIKKQDFLEKKIEVEIGVARKNGTKNKRAAIQALKRKKRYEKQLQQIDGTLSTIEMQREALEGANTNTAVLQTMKNAADALKAAHQHMDVDQ

SEQ ID NO: 1075 - DNA, 477 bp, Nilaparvata lugens
tccgcgtcgtccttacgagaaggcacgtctcgaacaggagttgaagatcatcggagagtatggactccgtaacaagcgtgaggtgtggagagtcaaatacgccctggccaagattcgtaaggccgctcgtgagctgttgactctggaagagaaggaccagaaacgtttgtttgaaggtaacgccctgctgcgtcgcctggtgcgtattggagtgttggacgaaggaagaatgaagctcgattacgtcttgggtttaaaaattgaagatttccttgaacgtcgtctacagactcaggtgtacaaactcggtttggccaagtccatccatcacgcccgtgtactcatcagacaaagacatatcagagtgcgcaaacaagtagtgaacattccgagctttgtggtgcgcctggactcgcagaagcacattgacttctcgctgaagtcgccgttcggcggtggccgacctggtcgcgtcaa

SEQ ID NO: 1076 - protein, 158 aa, Nilaparvata lugens
PRRPYEKARLEQELKIIGEYGLRNKREVWRVKYALAKIRKAARELLTLEEKDQKRLFEGNALLRRLVRIGVLDEGRMKLDYVLGLKIEDFLERRLQTQVYKLGLAKSIHHARVLIRQRHIRVRKQVVNIPSFVVRLDSQKHIDFSLKSPFGGGRPGRV

SEQ ID NO: 1077 - DNA, 339 bp, Nilaparvata lugens
aaggagttggctgctgtaagaactgtctgctctcacatcgaaaacatgctgaagggagtcacaaagggattcctgtacaagatgcgtgccgtgtacgcccatttccccatcaactgtgtgacgaccgagaacaactctgtgatcgaggtgcgtaacttcctgggcgagaagtacatccgacgggtgaggatggcgcccggcgtcactgttaccaactcgacaaagcagaaggacgagctcatcgtcgaaggaaacagcatagaggacgtgtcaagatcagctgccctcatccaacagtcaacaacagtgaagaacaaggatattcgtaaattcttggac

SEQ ID NO: 1078 - protein, 113 aa, Nilaparvata lugens
KELAAVRTVCSHIENMLKGVTKGFLYKMRAVYAHFPINCVTTENNSVIEVRNFLGEKYIRRVRMAPGVTVTNSTKQKDELIVEGNSIEDVSRSAALIQQSTTVKNKDIRKFLD

SEQ ID NO: 1079 - DNA, 453 bp, Nilaparvata lugens
ttggatcccaatgaaataaatgaaatcgcaaacacaaattcacgtcaaagcatcaggaagctgatcaaagacggtcttatcatcaagaaaccggttgcagtacattcacgtgctcgcgttcgtaaaaacactgaagccaggaggaaaggcagacattgtggctttggtaagaggaaaggtacagccaacgcccgtatgccacaaaaggttctatgggtgaatcgtatgcgtgtcttgagaagactgttgaaaaaatacagacaagataagaaaatcgacaggcatctgtaccatcacctttacatgaaggctaagggtaacgtattcaagaacaagcgtgtattgatggagttcattcataagaagaaggccgagaaagcaagaatgaagatgttgaacgaccaggctgaagctcgcagacaaaaggtcaaggaggccaagaagcgaagggaa

SEQ ID NO: 1080 - protein, 151 aa, Nilaparvata lugens
LDPNEINEIANTNSRQSIRKLIKDGLIIKKPVAVHSRARVRKNTEARRKGRHCGFGKRKGTANARMPQKVLWVNRMRVLRRLLKKYRQDKKIDRHLYHHLYMKAKGNVFKNKRVLMEFIHKKKAEKARMKMLNDQAEARRQKVKEAKKRRE

SEQ ID NO: 1081 - DNA, 1052 bp, Nilaparvata lugens
aagtgcttgtgtcaagtggtgtggtggagtacattgacaccctggaggaggagacgaccatgatagcgatgtcgccggatgacctgcgtcaggacaaggagtatgcctactgtaccacctacacgcactgcgagatccacccggccatgatactcggtgtgtgcgcctctattattcccttccccgatcacaaccaaagtcccaggaacacctatcagagcgctatggggaaacaggcgatgggcgtgtacatcaccaacttccacgtgcgaatggacacgctggctcacgtgctgttctacccgcacaagccactggtcaccactcgctccatggagtacctgcgcttcagggagcttcctgccggcatcaactctgtggtcgccatcgcctgctacactggatacaaccaggaggacagtgtcattctcaacgcctccgctgtcgagcgcggattcttcagatcggttttcttccgatcttacaaagatgcagaatcgaagcgtattggcgaccaagaggagcaattcgagaagcccaccagacagacgtgtcagggaatgaggaatgccatttatgacaaattggacgatgatggcatcattgctcccggtctgagagtgtctggtgacgatgtggttattggcaaaaccataacactgcccgataatgatgacgagctggaaggtacaacaaagaggttcacgaagagagatgccagtactttcctgcgtaacagtgagacgggaatcgtcgaccaagtcatgttaaccttgaactctgagggttacaagttctgcaaaattcgagtcaggtctgtgcgtatcccgcagattggcgataagttcgcttcccgacatggccaaaaaggaacgtgtggaatacagtatcgtcaagaggacatgccttttacaagcgagggaatcgcaccggatattattatcaatcctcacgctatcccatctcgtatgacaattggccatttaattgaatgtctccaaggaaaggtgtcgtcgaacaagggcgagataggtgacgcgacgccgttcaac

SEQ ID NO: 1082 - protein, 350 aa, Nilaparvata lugens
VLVSSGVVEYIDTLEEETTMIAMSPDDLRQDKEYAYCTTYTHCEIHPAMILGVCASIIPFPDHNQSPRNTYQSAMGKQAMGVYITNFHVRMDTLAHVLFYPHKPLVTTRSMEYLRFRELPAGINSVVAIACYTGYNQEDSVILNASAVERGFFRSVFFRSYKDAESKRIGDQEEQFEKPTRQTCQGMRNAIYDKLDDDGIIAPGLRVSGDDVVIGKTITLPDNDDELEGTTKRFTKRDASTFLRNSETGIVDQVMLTLNSEGYKFCKIRVRSVRIPQIGDKFASRHGQKGTCGIQYRQEDMPFTSEGIAPDIIINPHAIPSRMTIGHLIECLQGKVSSNKGEIGDATPFN

SEQ ID NO: 1083 - DNA, 958 bp, Nilaparvata lugens
tttcagagatttccttctgaaacctgaaattttgagagcaatccttgactgtggttttgaacatccatctgaagtacaacatgaatgcattcctcaagctgtacttggaatggacatattgtgtcaagcgaaatccggtatgggaaaaactgctgtatttgtgttggcgacattacagcaaattgaaccaactgacaaccaagtcagtgtattggtcatgtgtcataccagagagcttgcattccaaatcagcaaagagtatgaacgattttcgaaatgtatgccaaatatcaaggttggagttttcttcggcggactgccgattcagagggatgaggagacgttgaaattgaactgtcctcacatcgtggttggaacacccggacgaattttggcgttggtacgcaacaagaagctggacctcaagcatctcaagcactttgtccttgacgaatgtgacaaaatgttggaactgttagatatgcgaagagatgtgcaggaaatattccgaaacacgccgcacagcaaacaagtcatgatgttcagtgcaactctcagcaaagaaattcgtccagtctgcaagaaattcatgcaagatccgatggaagtgtacgttgatgacgaggccaagctgacgcttcacggcctgcagcagcactatgtcaaactcaaagaaaacgaaaagaacaaaaagttatttgaattacttgacatacttgaattcaaccaggttgttatatttgtgaagtcagtgcagcgctgcatggccctatcgcaactcctaacagagcagaacttccctgcagtggctattcaccgtggcatgacacaagaagaacgattgaagaaatatcaagagttcaaagagttcctaaagcgaattttggtagcaacgaatctgtttggcagaggaatggatattgagagagtcaacattgtattcaactatgacatgcct

SEQ ID NO: 1084 - protein, 319 aa, Nilaparvata lugens
FRDFLLKPEILRAILDCGFEHPSEVQHECIPQAVLGMDILCQAKSGMGKTAVFVLATLQQIEPTDNQVSVLVMCHTRELAFQISKEYERFSKCMPNIKVGVFFGGLPIQRDEETLKLNCPHIVVGTPGRILALVRNKKLDLKHLKHFVLDECDKMLELLDMRRDVQEIFRNTPHSKQVMMFSATLSKEIRPVCKKFMQDPMEVYVDDEAKLTLHGLQQHYVKLKENEKNKKLFELLDILEFNQVVIFVKSVQRCMALSQLLTEQNFPAVAIHRGMTQEERLKKYQEFKEFLKRILVATNLFGRGMDIERVNIVFNYDMP

SEQ ID NO: 1085 - DNA, 675 bp, Nilaparvata lugens
ggaaggatagaaaaccagaaacgagttgttggtgttcttttgggatgctggagacctggaggtgtattagatgtttcaaacagttttgcagttccatttgatgaggacgacaaagaaaagaatgtttggttcttagaccatgattacttggaaaacatgttcgggatgttcaagaaagttaatgctagagaaaaggttgtgggttggtaccatactggacccaaactccaccaaaacgatgttgcaatcaatgagttgattcgtcgttactgtccaaactgtgtcttagtcataatcgatgccaagcctaaagatttgggtctacctacagaggcatacagagtcgttgaagaaatccatgatgatggatcgccaacatcaaaaacatttgaacatgtgatgagtgagattggggcagaagaggctgaggagattggcgttgaacatctgttgagagacatcaaagatacaacagtcgggtcactgtcacagcgcgtcacaaatcagctgatgggcttgaagggcttgcatctgcaattacaggatatgcgagactatttgaatcaggttgtcgaaggaaagttgccaatgaaccatcaaatcgtttaccaactgcaagacatcttcaaccttctacccgatatcggccacggcaattttgtagactcgctctac

SEQ ID NO: 1086 - protein, 225 aa, Nilaparvata lugens
GRIENQKRVVGVLLGCWRPGGVLDVSNSFAVPFDEDDKEKNVWFLDHDYLENMFGMFKKVNAREKVVGWYHTGPKLHQNDVAINELIRRYCPNCVLVIIDAKPKDLGLPTEAYRVVEEIHDDGSPTSKTFEHVMSEIGAEEAEEIGVEHLLRDIKDTTVGSLSQRVTNQLMGLKGLHLQLQDMRDYLNQVVEGKLPMNHQIVYQLQDIFNLLPDIGHGNFVDSLY

SEQ ID NO: 1087 - DNA, 363 bp, Nilaparvata lugens
tgcgactatgatcgaccgccgggacgcggtcaggtgtgcgacgtcgacgtcaagaactggtttccctgcacctctgagaacaatttcaactaccatcaatcgagcccttgtgtttttctcaaactgaacaagataattggttggcaaccggagtactacaatgagactgaaggctttccagataatatgccaggtgacctcaagcgacacattgcccaacagaagagtatcaacaagctgtttatgcaaacaatctggataacttgcgaaggagagggtcctctagacaaggagaatgcaggggagatccagtacatccctagacagggatttccgggctacttctacccttacactaatgcc

SEQ ID NO: 1088 - protein, 121 aa, Nilaparvata lugens
CDYDRPPGRGQVCDVDVKNWFPCTSENNFNYHQSSPCVFLKLNKIIGWQPEYYNETEGFPDNMPGDLKRHIAQQKSINKLFMQTIWITCEGEGPLDKENAGEIQYIPRQGFPGYFYPYTNA

SEQ ID NO: 1089 - DNA, 769 bp, Nilaparvata lugens
gtccagtcgactggaagccaccaggcttgttgttcccgttggatgtctgtatcaacctttgaaggagagacctgatctaccgcctgtacagtacgatccagttctttgtactaggaatacttgtcgtgcaattctgaatccattgtgccaagtcgactatcgagccaagctatgggtctgcaacttttgtttccagaggaatcctttcccccctcaatatgcagctatttcggagcagcatcaaccagcagaactgataccttcattttccaccatcgaatacatcattaccagagcgcaaacgatgccgccgatgttcgtgctggtggtggacacatgtctggacgacgaggagctgggagctttgaaggactcactgcagatgtcgctgtcgctgctgccgcccaatgcactcatcggtctcatcacgttcggcaaaatggtgcaggtgcacgagcttggctgcgacggctgctcgaagagctacgtgttccgtggcgtgaaggacctgactgccaagcagatccaggacatgttgggcattggcaagatggccgccgctccacagcccatgcaacagcgcattcccggcgccgctccctccgcacctgtcaacagatttcttcagcctgtcggaaagtgcgatatgagtttaactgatctgcttggggaattgcaaagagatccatggaatgtggctcagggcaagagacctctccgatctactggagttgcattgtccattgcagttggtctgctcgagtgcaca

SEQ ID NO: 1090 - protein, 256 aa, Nilaparvata lugens
SSRLEATRLVVPVGCLYQPLKERPDLPPVQYDPVLCTRNTCRAILNPLCQVDYRAKLWVCNFCFQRNPFPPQYAAISEQHQPAELIPSFSTIEYIITRAQTMPPMFVLVVDTCLDDEELGALKDSLQMSLSLLPPNALIGLITFGKMVQVHELGCDGCSKSYVFRGVKDLTAKQIQDMLGIGKMAAAPQPMQQRIPGAAPSAPVNRFLQPVGKCDMSLTDLLGELQRDPWNVAQGKRPLRSTGVALSIAVGLLECT

SEQ ID NO: 1091 - DNA, 527 bp, Nilaparvata lugens
agatggtggtaccggcaaaactacatttgtcaaacgacatcttaccggagaatttgaaaagaagtatgttgccacccttggagttgaagttcacccccttgtatttcacacaaacagaggtgtgattaggttcaatgtgtgggacacagctggccaggaaaagttcggtggacttcgtgatggatattacattcagggacaatgcgccatcattatgtttgacgtaacgtcaagagtcacctacaagaacgttcccaactggcacagagatttagtgagggtttgcgaaaacattcccattgtactatgcggcaacaaagtagacatcaaggacaggaaagtcaaggccaagagcatagtcttccataggaagaagaaccttcagtactacgacatcagtgcgaaaagcaactacaacttcgagaagccgttcctgtggttggcaaagaagctgatcggtgaccccaacctggagttcgtcgccatgcccgccctcctcccacccgaggtcacaatggacccccaat

SEQ ID NO: 1092 - protein, 176 aa, Nilaparvata lugens
  misc_feature (176)..(176): Xaa can be any naturally occurring amino acid
DGGTGKTTFVKRHLTGEFEKKYVATLGVEVHPLVFHTNRGVIRFNVWDTAGQEKFGGLRDGYYIQGQCAIIMFDVTSRVTYKNVPNWHRDLVRVCENIPIVLCGNKVDIKDRKVKAKSIVFHRKKNLQYYDISAKSNYNFEKPFLWLAKKLIGDPNLEFVAMPALLPPEVTMDPQX

SEQ ID NO: 1093 - DNA, 169 bp, Nilaparvata lugens
gcagcagacgcaggcacaggtagacgaggttgtcgatataatgaaaacaaacgttgagaaagtattggagagggatcaaaaactatcagaattggatgatcgagcagatgctctacagcaaggcgcttcacagtttgaacagcaagctggcaaactcaagaggaaattc

SEQ ID NO: 1094 - protein, 56 aa, Nilaparvata lugens
QQTQAQVDEVVDIMKTNVEKVLERDQKLSELDDRADALQQGASQFEQQAGKLKRKF

SEQ ID NO: 1095 - DNA, 355 bp, Nilaparvata lugens
cgcagagcaagtctacatctcttcactggccttattgaaaatgcttaagcacggtcgcgccggtgttcccatggaagttatgggcctaatgctgggcgaatttgtagacgactacactgtgcgtgtcattgatgtattcgctatgccacagagtggaacgggagtgagtgtggaggctgtagacccggtgttccaagcgaagatgttggacatgctaaagcagacaggacggcccgagatggtggtgggctggtaccactcgcacccgggcttcggctgctggctgtcgggtgtcgacatcaacacgcaggagagcttcgagcaactatccaagagagccgttgccgtcgtcgtc

SEQ ID NO: 1096 - protein, 118 aa, Nilaparvata lugens
AEQVYISSLALLKMLKHGRAGVPMEVMGLMLGEFVDDYTVRVIDVFAMPQSGTGVSVEAVDPVFQAKMLDMLKQTGRPEMVVGWYHSHPGFGCWLSGVDINTQESFEQLSKRAVAVVV

SEQ ID NO: 1097 - DNA, 598 bp, Nilaparvata lugens
tttcattgagcaagaagccaatgagaaagccgaagagatcgatgccaaggccgaggaagaattcaacattgaaaagggaaggctcgtacagcaccagcgccttaaaatcatggagtactatgacaggaaagagaagcaggttgagctccagaaaaaaatccaatcgtcaaacatgctgaaccaagcgcgtctgaaggcactgaaggtgcgcgaagatcacgtgagaagtgtgctcgaagaatccagaaaacgtcttggagaagtaaccagaaacccagccaagtacaaggaagtcctccagtatctaattgtccaaggactcctgcagctgctagaatcaaacgtagtactgcgcgtgcgcgaggctgacgtgagtctgatcgagggcattgttggctcatgcgcagagcagtacgcgaagatgaccggcaaagaggtggtggtgaagctggacgctgacaacttcctggccgccgagacgtgtggaggcgtcgagttgttcgcccgcaacggccgcatcaagatccccaacaccctcgagtccaggctcgacctcatctcccagcaacttgtgcccgagattagagtcgcgctcttt

SEQ ID NO: 1098 - protein, 199 aa, Nilaparvata lugens
FIEQEANEKAEEIDAKAEEEFNIEKGRLVQHQRLKIMEYYDRKEKQVELQKKIQSSNMLNQARLKALKVREDHVRSVLEESRKRLGEVTRNPAKYKEVLQYLIVQGLLQLLESNVVLRVREADVSLIEGIVGSCAEQYAKMTGKEVVVKLDADNFLAAETCGGVELFARNGRIKIPNTLESRLDLISQQLVPEIRVALF

SEQ ID NO: 1099 - DNA, 986 bp, Nilaparvata lugens
attgtgctgtctgacgagacatgtccgttcgaaaagatccgcatgaatcgagtggtcaggaagaatctgcgagtgcgcttgtccgacattgtctcgatccagccttgcccagacgtcaagtatggaaagcgtatccatgtgctgcccattgatgataccgttgagggtcttacaggaaatctgttcgaagtgtatttgaagccatacttcctggaagcatacaggccaattcacaaggatgatgcattcattgttcgcggaggtatgagagcggtcgaattcaaggtggttgaaacagatccatcgccctactgcattgtcgcgccagacaccgtcatccattgtgagggagaccccatcaaacgtgaggatgaagaagacgcagcaaacgcagtcggctacgacgacattggaggctgcagaaagcagctggcgcagatcaaagagatggtggagttgccgctgagacatcccagtctgttcaaggcgatcggcgtgaagccgccacgaggcatcctgctgtacggaccaccgggaaccggaaagacgttgatagcgcgcgccgtcgccaacgaaacgggcgccttcttcttcctcatcaacggacccgagattatgagcaaattggccggcgagtcggagagtaacctgcgcaaagctttcgaggaagcggacaaaaacgcaccggccatcatcttcatcgatgagctggacgcaatcgcgccaaaacgcgagaagacgcacggcgaggtggagcgacgcatcgtgtcgcagctgctgacgctgatggacggtctcaagcagagctcgcacgtgattgtcatggccgccaccaatcggcccaactcgatcgatgccgcgcttaggcgctttggccgctttgatcgcgaaatcgacattggcattcccgatgccaccggtcgtctcgaggtgctgcgcatccacaccaagaacatgaagttggctgatgacgtcgatttggaaca

SEQ ID NO: 1100 - protein, 329 aa, Nilaparvata lugens
  misc_feature (329)..(329): Xaa can be any naturally occurring amino acid
IVLSDETCPFEKIRMNRVVRKNLRVRLSDIVSIQPCPDVKYGKRIHVLPIDDTVEGLTGNLFEVYLKPYFLEAYRPIHKDDAFIVRGGMRAVEFKVVETDPSPYCIVAPDTVIHCEGDPIKREDEEDAANAVGYDDIGGCRKQLAQIKEMVELPLRHPSLFKAIGVKPPRGILLYGPPGTGKTLIARAVANETGAFFFLINGPEIMSKLAGESESNLRKAFEEADKNAPAIIFIDELDAIAPKREKTHGEVERRIVSQLLTLMDGLKQSSHVIVMAATNRPNSIDAALRRFGRFDREIDIGIPDATGRLEVLRIHTKNMKLADDVDLEX

SEQ ID NO: 1101 - DNA, 691 bp, Nilaparvata lugens
gacgccagtatcagaagacatgcttggtcgtgtattcaacggaagtggtaagcccatcgacaaaggacctcccattcttgctgaggattatctcgacattcaaggtcaacccatcaatccttggtcgcgtatctatcccgaggaaatgatccagactggaatttcagccatcgacgtcatgaactcgattgctcgtggccagaaaatccccatcttttcagctgccggtctacctcacaacgaaattgctgctcaaatctgtagacaggctggtcttgtcaaactgccaggaaagtcagttctcgatgactctgaggacaactttgctattgtattcgcagccatgggagtcaacatggaaactgctcgattcttcaaacaggatttcgaggagaacggctctatggagaacgtgtgcctgttcttgaacctggcgaacgacccgacgatcgagcgtatcatcacaccacgcctggcgctgacggccgccgagttcctggcctaccagtgcgagaagcacgtgctcgtcatcctcaccgacatgagctcctacgccgaggcgctgcgagaggtgtccgccgcccgcgaggaggtgcccggccgtcgtggtttccccggttacatgtacaccgatctggccaccatctacgagcgcgccggacgagtcgagggtcgcaacggctccatcacg

SEQ ID NO: 1102 - protein, 230 aa, Nilaparvata lugens
TPVSEDMLGRVFNGSGKPIDKGPPILAEDYLDIQGQPINPWSRIYPEEMIQTGISAIDVMNSIARGQKIPIFSAAGLPHNEIAAQICRQAGLVKLPGKSVLDDSEDNFAIVFAAMGVNMETARFFKQDFEENGSMENVCLFLNLANDPTIERIITPRLALTAAEFLAYQCEKHVLVILTDMSSYAEALREVSAAREEVPGRRGFPGYMYTDLATIYERAGRVEGRNGSIT

SEQ ID NO: 1103 - DNA, 1099 bp, Nilaparvata lugens
tatgcaaatgcctgtgccacgcccacaaatagaaagcacacaacagtttattcgatccgagaaaacaacatactcgaatggattcaccaccattgaggaggacttcaaagtagacactttcgaataccgtcttctgcgcgaggtgtcgttccgcgaatctctgatcagaaactacttgcacgaggcggacatgcagatgtcgacggtggtggaccgagcattgggtcccccctcggcgccacacatccagcagaagccgcgcaactcaaaaatccaggagggcggcgatgccgtcttttccatcaagctcagcgccaaccccaagcctcggctggtctggttcaagaacggtcagcgcatcggtcagacgcagaaacaccaggcctcctactccaatcagaccgccacgctcaaggtcaacaaagtcagcgctcaagactccggccactacacgctgcttgctgaaaatccgcaaggatgtactgtgtcctcagcttacctagctgtcgaatcagctggcactcaagatacaggatacagtgagcaatacagcagacaagaggtggagacgacagaggcggtggacagcagcaagatgctggcaccgaactttgttcgcgtgccggccgatcgcgacgcgagcgaaggcaagatgacgcggtttgactgccgcgtgacgggccgaccctacccggacgtggcctggttcatcaacggccaacaggtggctgacgacgccacgcacaagatcctcgtcaacgagtctggcaaccactcgctcatgatcaccggcgtcactcgcttggaccacggagtggtcggctgtattgcccgcaacaaggctggcgaaacctcattccagtgcaacttgaatgtgatcgagaaagaactggttgtggcgccgaaatttgtggagagattcgcacaagtgaatgtgaaggagggtgagccggttgtgctgagcgcacgcgctgttggcacacctgttccaagaataacatggcagaaggacggcgccccgatccagtcgggaccgagcgtgagtctgtttgtggacggaggtgcgaccagcctggacatcccgtacgcgaaggcgtcg

SEQ ID NO: 1104 - protein, 366 aa, Nilaparvata lugens
MQMPVPRPQIESTQQFIRSEKTTYSNGFTTIEEDFKVDTFEYRLLREVSFRESLIRNYLHEADMQMSTVVDRALGPPSAPHIQQKPRNSKIQEGGDAVFSIKLSANPKPRLVWFKNGQRIGQTQKHQASYSNQTATLKVNKVSAQDSGHYTLLAENPQGCTVSSAYLAVESAGTQDTGYSEQYSRQEVETTEAVDSSKMLAPNFVRVPADRDASEGKMTRFDCRVTGRPYPDVAWFINGQQVADDATHKILVNESGNHSLMITGVTRLDHGVVGCIARNKAGETSFQCNLNVIEKELVVAPKFVERFAQVNVKEGEPVVLSARAVGTPVPRITWQKDGAPIQSGPSVSLFVDGGATSLDIPYAKAS

SEQ ID NO: 1105 - DNA, 402 bp, Nilaparvata lugens
cgatgacacatacacagaaagttacatcagtaccattggtgtagattttaaaattagaacaatagatctcgatggaaaaaccataaagcttcagatttgggacacggccggccaggagcggttccgcacgatcacatcgagctactaccggggcgcccacggcatcattgtggtgtacgactgcaccgaccaggagtcgttcaacaacctcaaacagtggctcgaggagattgaccgctacgcctgtgataatgtcaacaaactgctcgtcggcaacaagtgtgatcagaccaacaaaaaggtcgtcgactatacacaggctaaggaatacgccgaccagctgggcattccgttcctggagacgtcggcgaagaacgcgaccaatgtggagcaggcgttcat

SEQ ID NO: 1106 - protein, 133 aa, Nilaparvata lugens
DDTYTESYISTIGVDFKIRTIDLDGKTIKLQIWDTAGQERFRTITSSYYRGAHGIIVVYDCTDQESFNNLKQWLEEIDRYACDNVNKLLVGNKCDQTNKKVVDYTQAKEYADQLGIPFLETSAKNATNVEQAF

SEQ ID NO: 1107 - DNA, 493 bp, Nilaparvata lugens
cgtcagtctcaattctgtcaccgatatcagcaccacgttcattctcaagccacaagagaacgtgaagataacgcttgagggcgcacaggcctgtttcatttcacacgaacgacttgtgatctcactgaagggaggagaactctatgttctaactctctattccgatagtatgcgcagtgtgaggagttttcatctggagaaagctgctgccagtgtcttgactacttgtatctgtgtttgtgaggagaactatctgttccttggttcccgtcttggaaactcactgttgctcaggtttactgagaaggaattgaacctgattgagccgagggccatcgaaagctcacagtcccagaatccggccaagaagaaaaagctggatactttgggagattggatggcatctgacgtcactgaaatacgcgacctggatgaactagaagtgtatggcagtgaaacacaaacctctatgcaaattgcatcctacatattc

SEQ ID NO: 1108 - protein, 164 aa, Nilaparvata lugens
VSLNSVTDISTTFILKPQENVKITLEGAQACFISHERLVISLKGGELYVLTLYSDSMRSVRSFHLEKAAASVLTTCICVCEENYLFLGSRLGNSLLLRFTEKELNLIEPRAIESSQSQNPAKKKKLDTLGDWMASDVTEIRDLDELEVYGSETQTSMQIASYIF

SEQ ID NO: 1109 - DNA, 721 bp, Nilaparvata lugens
tacattgcacagagaattcctttccgagccagatctgcaatcttacagtgttatgataattgatgaagctcacgagaggacgttgcacactgatatactgttcggtttggtgaaagatgtcgcccgattcagacctgacttgaagctgctcatatcaagcgccacactggatgctcagaaattctccgagtttttcgacgatgcacccatcttcaggattccgggccgtagatttccggtggacatctactacacaaaggcgcccgaggctgactacgtggacgcatgtgtcgtttcgatcctgcagatccacgccactcagccgctgggagacatcctggtcttcctcaccggtcaggaggagatcgaaacctgccaggagctgctgcaggacagagtgcgcaggcttgggcctcgtatcaaggagctgctcatattgcccgtctattccaacctacccagtgatatgcaggcaaagattttcctgcccactccaccaaatgctagaaaggtagtattggccacaaatattgcagaaacctcattgaccatcgacaatataatctacgtgattgatcctggtttttgtaagcagaataacttcaattcaaggactggaatggaatcgcttgttgtagtgcctgtttcaaaggcatcggccaatcagcgagcagggcgggcgggacgggtggcggccggcaagtgcttccgtctgtacacg

SEQ ID NO: 1110 - protein, 240 aa, Nilaparvata lugens
TLHREFLSEPDLQSYSVMIIDEAHERTLHTDILFGLVKDVARFRPDLKLLISSATLDAQKFSEFFDDAPIFRIPGRRFPVDIYYTKAPEADYVDACVVSILQIHATQPLGDILVFLTGQEEIETCQELLQDRVRRLGPRIKELLILPVYSNLPSDMQAKIFLPTPPNARKVVLATNIAETSLTIDNIIYVIDPGFCKQNNFNSRTGMESLVVVPVSKASANQRAGRAGRVAAGKCFRLYT

SEQ ID NO: 1111 - DNA, 1681 bp, Nilaparvata lugens
ccggagcttctctcaggaacgccagcacgaggaaatgaaggaatcctcgggtcgcatgcatcacagcgatcctctaatcgtcgagactcatagcggtcacgtgagaggaatctcgaagaccgtcctcggacgggaggtccacgtgtttaccgggattccgtttgcgaaacctcccatcggtccgttgcgattccgtaaaccggttcccgtcgacccgtggcacggcgttctggatgcgaccgcgcttcccaacagctgctaccaggaacggtacgagtatttcccgggcttcgagggagaggaaatgtggaatccgaatacgaatttgtccgaagattgtctgtatttgaacatatgggtgccgcaccggttgagaatccgacacagagccaacagcgaggagaataaaccaagagcgaaggtgccggtgctgatctggatctacggcgggggttacatgagcggcacagctacactggacgtgtacgatgctgacatggtggccgccacgagtgacgtcatcgtcgcctccatgcagtaccgagtgggtgcgttcggcttcctctacctcgcacaggacttgcctcgaggcagcgaggaggcgccgggcaacatggggctctgggaccaggcccttgccatccgctggctcaaggacaacattgccgccttcggaggcgatcccgaactcatgacgctctttggcgagtcggctgggggtggatctgtaagcatccacttggtatcaccgataactcgcggcctagcgcgtcgtggcatcatgcagtcaggaacgatgaacgcaccgtggagcttcatgacggcggaacgcgcgaccgaaatcgccaagacgctcattgacgactgcggctgcaactcgtcgctcctgaccgacgctcccagtcgcgtcatgtcctgtatgcgatcagtcgaggcaaagatcatctccgtgcagcaatggaacagctactccggcattctcggacttccgtctgcacccaccatcgacggcattttcctgcccaaacatcccctcgatctgctcaaggaaggcgactttcaggacactgaaatactcatcggcagtaatcaggatgagggtacctacttcatattgtacgatttcatcgacttcttccaaaaagacgggccgagtttcttgcaaagagataagttcctagacatcatcaacacaattttcaagaatatgacgaaaattgagagggaagctatcatattccagtacacagattgggagcatgttatggatggttatctgaaccagaaaatgatcggagatgtggttggtgattacttcttcatctgtccgacaaatcatttcgcacaggcattcgcagagcatggaaagaaggtgtattactatttcttcacccagagaaccagtacaagtttatggggcgagtggatgggagtcatgcatggagatgaaatagaatacgtttttggtcatcctctcaacatgtcgctgcaattcaatgctagggaaagggatctcagtctgcgaataatgcaagcttactctaggtttgcattgacaggtaaaccagtgcctgatgacgtgaattggcctatctactccaaggaccagccgcagtattacattttcaatgcggagacttcgggcacaggcagaggacccagagcaacagcgtgtgctttc

SEQ ID NO: 1112 - protein, 560 aa, Nilaparvata lugens
RSFSQERQHEEMKESSGRMHHSDPLIVETHSGHVRGISKTVLGREVHVFTGIPFAKPPIGPLRFRKPVPVDPWHGVLDATALPNSCYQERYEYFPGFEGEEMWNPNTNLSEDCLYLNIWVPHRLRIRHRANSEENKPRAKVPVLIWIYGGGYMSGTATLDVYDADMVAATSDVIVASMQYRVGAFGFLYLAQDLPRGSEEAPGNMGLWDQALAIRWLKDNIAAFGGDPELMTLFGESAGGGSVSIHLVSPITRGLARRGIMQSGTMNAPWSFMTAERATEIAKTLIDDCGCNSSLLTDAPSRVMSCMRSVEAKIISVQQWNSYSGILGLPSAPTIDGIFLPKHPLDLLKEGDFQDTEILIGSNQDEGTYFILYDFIDFFQKDGPSFLQRDKFLDIINTIFKNMTKIEREAIIFQYTDWEHVMDGYLNQKMIGDVVGDYFFICPTNHFAQAFAEHGKKVYYYFFTQRTSTSLWGEWMGVMHGDEIEYVFGHPLNMSLQFNARERDLSLRIMQAYSRFALTGKPVPDDVNWPIYSKDQPQYYIFNAETSGTGRGPRATACAF

SEQ ID NO: 1113 - DNA, 850 bp, Nilaparvata lugens
agaagacggcacggtgcgtatttggcactcgggcacctacaggctggagtcctcgctgaattatggcctcgaaagagtgtggaccatttgctgcatgcgaggatccaacaatgtggctcttggctacgacgaaggcagcataatggtgaaggtgggtcgggaggagccggccatctcgatggatgtgaacggtgagaagattgtgtgggcgcgccactcggagatacaacaggtcaacctcaaggccatgccggagggcgtcgaaatcaaagatggcgaacgactgccggtcgccgttaaggatatgggcagctgtgaaatatatccgcagaccatcgctcataatcccaacggcagattcctagtcgtttgtggagatggagagtacataattcacacatcaatggtgctaagaaataaggcgtttggctcggcccaagagttcatttggggacaggactcgtccgagtatgctatcagagaaggaacatccactgtcaaagtattcaaaaacttcaaagaaaagaaatcattcaagccagaatttggtgctgagagcatattcggcggctacctgctgggagtttgttcgttgtctggactggcgctgtacgactgggagaccctggagctggtgcgtcgcatcgagatccaaccgaaacacgtgtactggtcggagagtggggagctggtggcgctggccactgatgactcctactttgtgctccgctacgacgcacaggccgtgctcgctgcacgcgacgccggtgacgacgctgtcacgccggacggcgtcgaggatgcattcgaggtccttggtgaagtgcacgaaactgtaaaaactggattg

SEQ ID NO: 1114 - protein, 299 aa, Nilaparvata lugens
PIVLTGSEDGTVRIWHSGTYRLESSLNYGLERVWTICCMRGSNNVALGYDEGSIMVKVGREEPAISMDVNGEKIVWARHSEIQQVNLKAMPEGVEIKDGERLPVAVKDMGSCEIYPQTIAHNPNGRFLVVCGDGEYIIHTSMVLRNKAFGSAQEFIWGQDSSEYAIREGTSTVKVFKNFKEKKSFKPEFGAESIFGGYLLGVCSLSGLALYDWETLELVRRIEIQPKHVYWSESGELVALATDDSYFVLRYDAQAVLAARDAGDDAVTPDGVEDAFEVLGEVHETVKTGLWVGDCFIYT

SEQ ID NO: 1115 - DNA, 751 bp, Nilaparvata lugens
cgttgaacgtgaaaggctcgtgtgtgtcagacactgacattggcttgggcggcacctctcaatggaaaatgtgcgccttcactccacacacaacttgtgcattcttcttcgaagttgtcaaccagcacgcagccccaatcccacagggaggaagaggatgcatccaattcattacgcaataccaacattccagtggccagagaaggatacgtgtcaccaccatcgctcgaaactgggcagatgcgagcaccaacctggcacacatcagtgccggcttcgaccaggaggcaggagccgtgctgatggcccgcatggtcgtgcatcgcgccgagactgacgatggacctgacgtcatgcgctgggctgaccgcatgctcatccgtctctgtcagaggttcggtgaatacagtaaggatgaccctaacagtttccgtctgccagagaacttcacactttatccgcagttcatgtaccatctgcgtcgatcccaattcttgcaagtgttcaacaacagtcctgatgaaacatcttactacaggcacattcttatgcgagaggatctgactcagagtttgattatgatccagccgattttgtacagctacagcttcaatggtccccccgagccagtgctgctcgacaccagcagtattcaacccgacagaatcctattgatggacacatttttccaaattctcattttccatggagagacgattgctcaatggcgatctctgggctaccaggacat

SEQ ID NO: 1116 - protein, 240 aa, Nilaparvata lugens
LNVKGSCVSDTDIGLGGTSQWKMCAFTPHTTCAFFFEVVNQHAAPIPQGGRGCIQFITQYQHSSGQRRIRVTTIARNWADASTNLAHISAGFDQEAGAVLMARMVVHRAETDDGPDVMRWADRMLIRLCQRFGEYSKDDPNSFRLPENFTLYPQFMYHLRRSQFLQVFNNSPDETSYYRHILMREDLTQSLIMIQPILYSYSFNGPPEPVLLDTSSIQPDRILLMDTFFQILIFHGETIA

SEQ ID NO: 1117 - DNA, 26 bp, Artificial Sequence
  synthetic oligo
gaaatcatggatgttggacaaattgg

SEQ ID NO: 1118 - DNA, 22 bp, Artificial Sequence
  synthetic oligo
actgagcttcacacccttgccc

SEQ ID NO: 1119 - DNA, 24 bp, Artificial Sequence
  synthetic oligo
gatgaaaagggccctacaactggc

SEQ ID NO: 1120 - DNA, 26 bp, Artificial Sequence
  synthetic oligo
ctgatccacatccatgtgttgatgag

SEQ ID NO: 1121 - DNA, 24 bp, Artificial Sequence
  synthetic oligo
tccgcgtcgtccttacgagaaggc

SEQ ID NO: 1122 - DNA, 22 bp, Artificial Sequence
  synthetic oligo
ttgacgcgaccaggtcggccac

SEQ ID NO: 1123 - DNA, 28 bp, Artificial Sequence
  synthetic oligo
tgaaggtggagaarggttyggmwcmaag

SEQ ID NO: 1124 - DNA, 26 bp, Artificial Sequence
  synthetic oligo
gtcgtcttctcdgahacrtavagacc

SEQ ID NO: 1125 - DNA, 30 bp, Artificial Sequence; identical to SEQ ID NO: 613
  synthetic oligo

SEQ ID NO: 1126 - DNA, 26 bp, Artificial Sequence
  synthetic oligo
tcctgcttcttsgyrgcratwcgytc

SEQ ID NO: 1127 - DNA, 29 bp, Artificial Sequence
  synthetic oligo
ggagcgagactacaacaaykayrgytggc

SEQ ID NO: 1128 - DNA, 26 bp, Artificial Sequence
  synthetic oligo
gagatcttctgcacrttkacvgcatc

SEQ ID NO: 1129 - DNA, 22 bp, Artificial Sequence
  synthetic oligo
cggtgtccattcacagytccgg

SEQ ID NO: 1130 - DNA, 26 bp, Artificial Sequence
  synthetic oligo
cgatgcaagtaggtgtckgartcytc

SEQ ID NO: 1131 - DNA, 24 bp, Artificial Sequence
  synthetic oligo
gtggtggatcacttyaaycgkatg

SEQ ID NO: 1132 - DNA, 24 bp, Artificial Sequence
  synthetic oligo
gcgcatttgatcgttbgtyttcac

SEQ ID NO: 1133 - DNA, 25 bp, Artificial Sequence
  synthetic oligo
gggccgtggtcagaayatywayaac

SEQ ID NO: 1134 - DNA, 25 bp, Artificial Sequence
  synthetic oligo
ccgccaaaggactsarrtadccctc

SEQ ID NO: 1135 - DNA, 23 bp, Artificial Sequence
  synthetic oligo
cggctgacgtggaaygtktggcc

SEQ ID NO: 1136 - DNA, 24 bp, Artificial Sequence
  synthetic oligo
tgccggaagttctcrtaytckggc

SEQ ID NO: 1137 - DNA, 26 bp, Artificial Sequence
  synthetic oligo
cccactttcaagtgygtrytrgtcgg

SEQ ID NO: 1138 - DNA, 25 bp, Artificial Sequence
  synthetic oligo
cgctctctctcgatctgydsctgcc

SEQ ID NO: 1139 - DNA, 21 bp, Artificial Sequence
  synthetic oligo
gcaggcgcaggtbgabgargt

SEQ ID NO: 1140 - DNA, 24 bp, Artificial Sequence
  synthetic oligo
gaatttcctcttsagyttbccvgc

SEQ ID NO: 1141 - DNA, 22 bp, Artificial Sequence
  synthetic oligo
cagatgcgcccgtbgtdgayac

SEQ ID NO: 1142 - DNA, 24 bp, Artificial Sequence
  synthetic oligo
gcccttgacagaytgdatvggatc

SEQ ID NO: 1143 - DNA, 22 bp, Artificial Sequence
  synthetic oligo
cgcagatcaarcayatgatggc

SEQ ID NO: 1144 - DNA, 24 bp, Artificial Sequence
  synthetic oligo
gaacttgcggttgabgttscgdcc

SEQ ID NO: 1145 - DNA, 20 bp, Artificial Sequence
  synthetic oligo
gccgcaaggagacbgtvtgc

SEQ ID NO: 1146 - DNA, 23 bp, Artificial Sequence
  synthetic oligo
gtccgtgggaytcrgchgcaatc

SEQ ID NO: 1147 - DNA, 21 bp, Artificial Sequence
  synthetic oligo
gttcaccggcgayatyctgcg

SEQ ID NO: 1148 - DNA, 24 bp, Artificial Sequence
  synthetic oligo
cggcatagtcagaatsggratctg

SEQ ID NO: 1149 - DNA, 25 bp, Artificial Sequence
  synthetic oligo
  misc_feature (20)..(20): n is a, c, g, or t
gctccgtctacathcarccngargg

SEQ ID NO: 1150 - DNA, 23 bp, Artificial Sequence
  synthetic oligo
gtgcatcggtaccahschgcrtc

SEQ ID NO: 1151 - DNA, 24 bp, Artificial Sequence
  synthetic oligo
gtcctgtctgctgctvmgwttygc

SEQ ID NO: 1152 - DNA, 23 bp, Artificial Sequence
  synthetic oligo
ccttgatctchgcmgccatbgtc

SEQ ID NO: 1153 - DNA, 26 bp, Artificial Sequence
  synthetic oligo
ctcaatcagagcgtycchccrtaygg

SEQ ID NO: 1154 - DNA, 21 bp, Artificial Sequence
  synthetic oligo
ggaattgccsagvcgdgadcc

SEQ ID NO: 1155 - DNA, 25 bp, Artificial Sequence
  synthetic oligo
gcgtgctcaagtayatgacbgaygg

SEQ ID NO: 1156 - DNA, 25 bp, Artificial Sequence
  synthetic oligo
  misc_feature (17)..(17): n is a, c, g, or t
  misc_feature (23)..(23): n is a, c, g, or t
ccagttcatgcttrtangcccangc

SEQ ID NO: 1157 - DNA, 22 bp, Artificial Sequence
  synthetic oligo
ccggagcttctctcaggaacgc

SEQ ID NO: 1158 - DNA, 23 bp, Artificial Sequence
  synthetic oligo
gaaagcacacgctgttgctctgg

SEQ ID NO: 1159 - DNA, 21 bp, Artificial Sequence
  synthetic oligo
gccgatcgtkytvackggctc

SEQ ID NO: 1160 - DNA, 27 bp, Artificial Sequence
  synthetic oligo
ggtatagatgaarcartcdccvaccca

SEQ ID NO: 1161 - DNA, 22 bp, Nilaparvata lugens
ctgaagaagctaagtacaagct

SEQ ID NO: 1162 - DNA, 26 bp, Nilaparvata lugens
ttcttccgtttgatctatgatgttaa

SEQ ID NO: 1163 - DNA, 22 bp, Nilaparvata lugens
cagctgaagaagctaagtacaa

SEQ ID NO: 1164 - DNA, 29 bp, Nilaparvata lugens
gagttcttccgtttgatctatgatgttaa

SEQ ID NO: 1165 - DNA, 24 bp, Nilaparvata lugens
aagtacaagctgtgcaaagtgaag

SEQ ID NO: 1166 - DNA, 24 bp, Nilaparvata lugens
ttcgacatcgtgcacatcaaggac

SEQ ID NO: 1167 - DNA, 27 bp, Nilaparvata lugens
atcacagctgaagaagctaagtacaag

SEQ ID NO: 1168 - DNA, 25 bp, Nilaparvata lugens
tgtgtatgatcactggaggtcgtaa

SEQ ID NO: 1169 - DNA, 21 bp, Nilaparvata lugens
aacgttttcatcatcggcaag

SEQ ID NO: 1170 - DNA, 21 bp, Nilaparvata lugens
ccaaaatcatggacttcatca

SEQ ID NO: 1171 - DNA, 22 bp, Nilaparvata lugens
tgatctatgatgttaagggacg

SEQ ID NO: 1172 - DNA, 22 bp, Nilaparvata lugens
catggatgttggacaaattggg

SEQ ID NO: 1173 - DNA, 24 bp, Nilaparvata lugens
ttttgccactaggttgaacaacgt

SEQ ID NO: 1174 - DNA, 27 bp, Nilaparvata lugens
gcagcgtctcatcaaggttgacggcaa

SEQ ID NO: 1175 - DNA, 21 bp, Nilaparvata lugens
aagggacgtttcaccatccac

SEQ ID NO: 1176 - DNA, 23 bp, Nilaparvata lugens
aacctgtgtatgatcactggagg

SEQ ID NO: 1177 - DNA, 26 bp, Nilaparvata lugens
actaactgtgaagtgaagaaaattgt

SEQ ID NO: 1178 - DNA, 23 bp, Nilaparvata lugens
ttcttccgtttgatctatgatgt

SEQ ID NO: 1179 - DNA, 29 bp, Nilaparvata lugens
tgtatgatcactggaggtcgtaacttggg

SEQ ID NO: 1180 - DNA, 25 bp, Nilaparvata lugens
catggatgttggacaaattgggtgg

SEQ ID NO: 1181 - DNA, 21 bp, Nilaparvata lugens
gctgaagaagctaagtacaag

SEQ ID NO: 1182 - DNA, 23 bp, Nilaparvata lugens
ggaggtcgtaacttgggtcgtgt

SEQ ID NO: 1183 - DNA, 26 bp, Nilaparvata lugens
tatgatgttaagggacgtttcaccat

SEQ ID NO: 1184 - DNA, 22 bp, Nilaparvata lugens
catggatgttggacaaattggg

SEQ ID NO: 1185 - DNA, 22 bp, Nilaparvata lugens
ctgaagaagctaagtacaagct

SEQ ID NO: 1186 - DNA, 23 bp, Nilaparvata lugens
gaagaagctaagtacaagctgtg

SEQ ID NO: 1187 - DNA, 26 bp, Nilaparvata lugens
ttgcacagcttgtacttagcttcttc

SEQ ID NO: 1188 - DNA, 24 bp, Nilaparvata lugens
aagtacaagctgtgcaaagtgaag

SEQ ID NO: 1189 - DNA, 29 bp, Nilaparvata lugens
atgatcactggaggtcgtaacttgggtcg

SEQ ID NO: 1190 - DNA, 23 bp, Nilaparvata lugens
ggtcgtaacttgggtcgtgtggg

SEQ ID NO: 1191 - DNA, 24 bp, Nilaparvata lugens
ttcgacatcgtgcacatcaaggac

SEQ ID NO: 1192 - DNA, 21 bp, Nilaparvata lugens
acatcgtgcacatcaaggacg

SEQ ID NO: 1193 - DNA, 29 bp, Nilaparvata lugens
caggagttgaagatcatcggagagtatgg

SEQ ID NO: 1194 - DNA, 21 bp, Nilaparvata lugens
cgtaaggccgctcgtgagctg

SEQ ID NO: 1195 - DNA, 22 bp, Nilaparvata lugens
aaggtaacgccctgctgcgtcg

SEQ ID NO: 1196 - DNA, 26 bp, Nilaparvata lugens
caggagttgaagatcatcggagagta

SEQ ID NO: 1197 - DNA, 23 bp, Nilaparvata lugens
gccaagtccatccatcacgcccg

SEQ ID NO: 1198 - DNA, 21 bp, Nilaparvata lugens
aagtccatccatcacgcccgt

SEQ ID NO: 1199 - DNA, 22 bp, Nilaparvata lugens
tgtttgaaggtaacgccctgct

SEQ ID NO: 1200 - DNA, 23 bp, Nilaparvata lugens
caggagttgaagatcatcggaga

SEQ ID NO: 1201 - DNA, 26 bp, Nilaparvata lugens
gtgcgcctggactcgcagaagcacat

SEQ ID NO: 1202 - DNA, 23 bp, Nilaparvata lugens
gagttgaagatcatcggagagta

SEQ ID NO: 1203 - DNA, 24 bp, Nilaparvata lugens
ttgggtttaaaaattgaagatttc

SEQ ID NO: 1204 - DNA, 23 bp, Nilaparvata lugens
tcgcagaagcacattgacttctc

SEQ ID NO: 1205 - DNA, 21 bp, Nilaparvata lugens
agaatgaagctcgattacgtc

SEQ ID NO: 1206 - DNA, 21 bp, Nilaparvata lugens
tttgtggtgcgcctggactcg

SEQ ID NO: 1207 - DNA, 28 bp, Nilaparvata lugens
agaagcacattgacttctcgctgaagtc

SEQ ID NO: 1208 - DNA, 26 bp, Nilaparvata lugens
tcgcagaagcacattgacttctcgct

SEQ ID NO: 1209 - DNA, 26 bp, Nilaparvata lugens
ctcatcagacaaagacatatcagagt

SEQ ID NO: 1210 - DNA, 23 bp, Nilaparvata lugens
ttgaagatcatcggagagtatgg

SEQ ID NO: 1211 - DNA, 21 bp, Nilaparvata lugens
aaaattgaagatttccttgaa

SEQ ID NO: 1212 - DNA, 23 bp, Nilaparvata lugens
cagaagcacattgacttctcgct

SEQ ID NO: 1213 - DNA, 21 bp, Nilaparvata lugens
cgtaaggccgctcgtgagctg

SEQ ID NO: 1214 - DNA, 23 bp, Nilaparvata lugens
gcgtgatggatggacttggccaa

SEQ ID NO: 1215 - DNA, 23 bp, Nilaparvata lugens
gccaagtccatccatcacgcccg

SEQ ID NO: 1216 - DNA, 24 bp, Nilaparvata lugens
gccaagtccatccatcacgcccgt

SEQ ID NO: 1217 - DNA, 26 bp, Nilaparvata lugens
ctcatcagacaaagacatatcagagt

SEQ ID NO: 1218 - DNA, 23 bp, Nilaparvata lugens
caggagttgaagatcatcggaga

SEQ ID NO: 1219 - DNA, 29 bp, Nilaparvata lugens
caggagttgaagatcatcggagagtatgg

SEQ ID NO: 1220 - DNA, 23 bp, Nilaparvata lugens
gagttgaagatcatcggagagta

SEQ ID NO: 1221 - DNA, 23 bp, Nilaparvata lugens
tcgcagaagcacattgacttctc

SEQ ID NO: 1222 - DNA, 23 bp, Nilaparvata lugens
ttgaagatcatcggagagtatgg

SEQ ID NO: 1223 - DNA, 26 bp, Nilaparvata lugens
cagaagcacattgacttctcgctgaa

SEQ ID NO: 1224 - DNA, 24 bp, Nilaparvata lugens
ctccgtaacaagcgtgaggtgtgg

SEQ ID NO: 1225 - DNA, 21 bp, Nilaparvata lugens
cgtaacaagcgtgaggtgtgg

SEQ ID NO: 1226 - DNA, 23 bp, Nilaparvata lugens
gtcaaatacgccctggccaagat

SEQ ID NO: 1227 - DNA, 26 bp, Nilaparvata lugens
tacgcccatttccccatcaactgtgt

SEQ ID NO: 1228 - DNA, 21 bp, Nilaparvata lugens
tgctctcacatcgaaaacatg

SEQ ID NO: 1229 - DNA, 24 bp, Nilaparvata lugens
aacttcctgggcgagaagtacatc

SEQ ID NO: 1230 - DNA, 29 bp, Nilaparvata lugens
gccgtgtacgcccatttccccatcaactg

SEQ ID NO: 1231 - DNA, 32 bp, Nilaparvata lugens
gtgtacgcccatttccccatcaactgtgtgac

SEQ ID NO: 1232 - DNA, 29 bp, Nilaparvata lugens
gtgtacgcccatttccccatcaactgtgt

SEQ ID NO: 1233 - DNA, 23 bp, Nilaparvata lugens
atgcgtgccgtgtacgcccattt

SEQ ID NO: 1234 - DNA, 23 bp, Nilaparvata lugens
tcagctgccctcatccaacagtc

SEQ ID NO: 1235 - DNA, 23 bp, Nilaparvata lugens
aaggatattcgtaaattcttgga

SEQ ID NO: 1236 - DNA, 23 bp, Nilaparvata lugens
gcccatttccccatcaactgtgt

SEQ ID NO: 1237 - DNA, 23 bp, Nilaparvata lugens
aacttcctgggcgagaagtacat

SEQ ID NO: 1238 - DNA, 29 bp, Nilaparvata lugens
aagaacaaggatattcgtaaattcttgga

SEQ ID NO: 1239 - DNA, 26 bp, Nilaparvata lugens
aacttcctgggcgagaagtacatccg

SEQ ID NO: 1240 - DNA, 23 bp, Nilaparvata lugens
catttccccatcaactgtgtgac

SEQ ID NO: 1241 - DNA, 29 bp, Nilaparvata lugens
cgtaacttcctgggcgagaagtacatccg

SEQ ID NO: 1242 - DNA, 23 bp, Nilaparvata lugens
agatcagctgccctcatccaaca

SEQ ID NO: 1243 - DNA, 29 bp, Nilaparvata lugens
gtgtacgcccatttccccatcaactgtgt

SEQ ID NO: 1244 - DNA, 24 bp, Nilaparvata lugens
tacgcccatttccccatcaactgt

SEQ ID NO: 1245 - DNA, 26 bp, Nilaparvata lugens
tacgcccatttccccatcaactgtgt

SEQ ID NO: 1246 - DNA, 23 bp, Nilaparvata lugens
gcccatttccccatcaactgtgt

SEQ ID NO: 1247 - DNA, 23 bp, Nilaparvata lugens
acacagttgatggggaaatgggc

SEQ ID NO: 1248 - DNA, 23 bp, Nilaparvata lugens
gcccatttccccatcaactgtgt

SEQ ID NO: 1249 - DNA, 26 bp, Nilaparvata lugens
gtcacacagttgatggggaaatgggc

SEQ ID NO: 1250 - DNA, 21 bp, Nilaparvata lugens
ccatttccccatcaactgtgt

SEQ ID NO: 1251 - DNA, 26 bp, Nilaparvata lugens
aagggtaacgtattcaagaacaagcg

SEQ ID NO: 1252 - DNA, 24 bp, Nilaparvata lugens
aagggtaacgtattcaagaacaag

SEQ ID NO: 1253 - DNA, 23 bp, Nilaparvata lugens
cgtgtattgatggagttcattca

SEQ ID NO: 1254 - DNA, 22 bp, Nilaparvata lugens
aaaggtcaaggaggccaagaag

SEQ ID NO: 1255 - DNA, 26 bp, Nilaparvata lugens
aagatgttgaacgaccaggctgaagc

SEQ ID NO: 1256 - DNA, 23 bp, Nilaparvata lugens
acgttacccttagccttcatgta

SEQ ID NO: 1257 - DNA, 26 bp, Nilaparvata lugens
aagggtaacgtattcaagaacaagcg

SEQ ID NO: 1258 - DNA, 23 bp, Nilaparvata lugens
cgtgtattgatggagttcattca

SEQ ID NO: 1259 - DNA, 21 bp, Nilaparvata lugens
aggtcaaggaggccaagaagc

SEQ ID NO: 1260 - DNA, 23 bp, Nilaparvata lugens
acgttacccttagccttcatgta

SEQ ID NO: 1261 - DNA, 26 bp, Nilaparvata lugens
aagggtaacgtattcaagaacaagcg

SEQ ID NO: 1262 - DNA, 21 bp, Nilaparvata lugens
agtcccaggaacacctatcag

SEQ ID NO: 1263 - DNA, 23 bp, Nilaparvata lugens
attattcccttccccgatcacaa

SEQ ID NO: 1264 - DNA, 29 bp, Nilaparvata lugens
cacgctatcccatctcgtatgacaattgg

SEQ ID NO: 1265 - DNA, 23 bp, Nilaparvata lugens
tacaagttctgcaaaattcgagt

SEQ ID NO: 1266 - DNA, 26 bp, Nilaparvata lugens
atgacaattggccatttaattgaatg

SEQ ID NO: 1267 - DNA, 23 bp, Nilaparvata lugens
acctacacgcactgcgagatcca

SEQ ID NO: 1268 - DNA, 23 bp, Nilaparvata lugens
ggtgtggtggagtacattgacac

SEQ ID NO: 1269 - DNA, 23 bp, Nilaparvata lugens
attattcccttccccgatcacaa

SEQ ID NO: 1270 - DNA, 21 bp, Nilaparvata lugens
agtcccaggaacacctatcag

SEQ ID NO: 1271 - DNA, 29 bp, Nilaparvata lugens
cacgctatcccatctcgtatgacaattgg

SEQ ID NO: 1272 - DNA, 23 bp, Nilaparvata lugens
tctcgtatgacaattggccattt

SEQ ID NO: 1273 - DNA, 22 bp, Nilaparvata lugens
gcaaacaagtcatgatgttcag

SEQ ID NO: 1274 - DNA, 29 bp, Nilaparvata lugens
ggtatgggaaaaactgctgtatttgtgtt

SEQ ID NO: 1275 - DNA, 21 bp, Nilaparvata lugens
gaatgcattcctcaagctgta

SEQ ID NO: 1276 - DNA, 23 bp, Nilaparvata lugens
tgcaagaaattcatgcaagatcc

SEQ ID NO: 1277 - DNA, 23 bp, Nilaparvata lugens
ttccaaatcagcaaagagtatga

SEQ ID NO: 1278 - DNA, 23 bp, Nilaparvata lugens
gatgacgaggccaagctgacgct

SEQ ID NO: 1279 - DNA, 32 bp, Nilaparvata lugens
tgtggttttgaacatccatctgaagtacaaca

SEQ ID NO: 1280 - DNA, 21 bp, Nilaparvata lugens
gaaaacgaaaagaacaaaaag

SEQ ID NO: 1281 - DNA, 29 bp, Nilaparvata lugens
ggtatgggaaaaactgctgtatttgtgtt

SEQ ID NO: 1282 - DNA, 22 bp, Nilaparvata lugens
gcaaacaagtcatgatgttcag

SEQ ID NO: 1283 - DNA, 26 bp, Nilaparvata lugens
ctgcagcagcactatgtcaaactcaa

SEQ ID NO: 1284 - DNA, 21 bp, Nilaparvata lugens
gaaaacgaaaagaacaaaaag

SEQ ID NO: 1285 - DNA, 21 bp, Nilaparvata lugens
tgccaagcctaaagatttggg

SEQ ID NO: 1286 - DNA, 26 bp, Nilaparvata lugens
atgttcaagaaagttaatgctagaga

SEQ ID NO: 1287 - DNA, 25 bp, Nilaparvata lugens
gagttgttggtgttcttttgggatg

SEQ ID NO: 1288 - DNA, 22 bp, Nilaparvata lugens
tttcaaacagttttgcagttcc

SEQ ID NO: 1289 - DNA, 25 bp, Nilaparvata lugens
gagttgttggtgttcttttgggatg

SEQ ID NO: 1290 - DNA, 21 bp, Nilaparvata lugens
aaggacctgactgccaagcag

SEQ ID NO: 1291 - DNA, 21 bp, Nilaparvata lugens
gccaagcagatccaggacatg

SEQ ID NO: 1292 - DNA, 23 bp, Nilaparvata lugens
tgctcgaagagctacgtgttccg

SEQ ID NO: 1293 - DNA, 21 bp, Nilaparvata lugens
aagagctacgtgttccgtggc

SEQ ID NO: 1294 - DNA, 21 bp, Nilaparvata lugens
aaggacctgactgccaagcag

SEQ ID NO: 1295 - DNA, 26 bp, Nilaparvata lugens
atggacacatttttccaaattctcat

SEQ ID NO: 1296 - DNA, 22 bp, Nilaparvata lugens
accagcagtattcaacccgaca

SEQ ID NO: 1297 - DNA, 22 bp, Nilaparvata lugens
tattgatggacacatttttcca

SEQ ID NO: 1298 - DNA, 23 bp, Nilaparvata lugens
ttcaacaacagtcctgatgaaac

SEQ ID NO: 1299 - DNA, 21 bp, Nilaparvata lugens
atggacacatttttccaaatt

SEQ ID NO: 1300 - DNA, 23 bp, Nilaparvata lugens
ccgcagttcatgtaccatctgcg

SEQ ID NO: 1301 - DNA, 21 bp, Nilaparvata lugens
atggacacatttttccaaatt

SEQ ID NO: 1302 - DNA, 23 bp, Nilaparvata lugens
aagaagtatgttgccacccttgg

SEQ ID NO: 1303 - DNA, 38 bp, Nilaparvata lugens
gacatcaaggacaggaaagtcaaggccaagagcatagt

SEQ ID NO: 1304 - DNA, 31 bp, Nilaparvata lugens
caactacaacttcgagaagccgttcctgtgg

SEQ ID NO: 1305 - DNA, 23 bp, Nilaparvata lugens
tacaagaacgttcccaactggca

SEQ ID NO: 1306 - DNA, 23 bp, Nilaparvata lugens
tgcgaaaacattcccattgtact

SEQ ID NO: 1307 - DNA, 26 bp, Nilaparvata lugens
aggaagaagaaccttcagtactacga

SEQ ID NO: 1308 - DNA, 23 bp, Nilaparvata lugens
agcaactacaacttcgagaagcc

SEQ ID NO: 1309 - DNA, 32 bp, Nilaparvata lugens
aacaaagtagacatcaaggacaggaaagtcaa

SEQ ID NO: 1310 - DNA, 24 bp, Nilaparvata lugens
cccaactggcacagagatttagtg

SEQ ID NO: 1311 - DNA, 23 bp, Nilaparvata lugens
gatggtggtaccggcaaaactac

SEQ ID NO: 1312 - DNA, 24 bp, Nilaparvata lugens
tacaagaacgttcccaactggcac

SEQ ID NO: 1313 - DNA, 32 bp, Nilaparvata lugens; identical to SEQ ID NO: 1309

SEQ ID NO: 1314 - DNA, 23 bp, Nilaparvata lugens
ttgactttcctgtccttgatgtc

SEQ ID NO: 1315 - DNA, 26 bp, Nilaparvata lugens
gacatcaaggacaggaaagtcaaggc

SEQ ID NO: 1316 - DNA, 26 bp, Nilaparvata lugens
aggaagaagaaccttcagtactacga

SEQ ID NO: 1317 - DNA, 24 bp, Nilaparvata lugens
gatgtcgtagtactgaaggttctt

SEQ ID NO: 1318 - DNA, 31 bp, Nilaparvata lugens; identical to SEQ ID NO: 1304

SEQ ID NO: 1319 - DNA, 25 bp, Nilaparvata lugens
ccaacctggagttcgtcgccatgcc

SEQ ID NO: 1320 - DNA, 23 bp, Nilaparvata lugens
gaatttgaaaagaagtatgttgc

SEQ ID NO: 1321 - DNA, 26 bp, Nilaparvata lugens
cttcagtactacgacatcagtgcgaa

SEQ ID NO: 1322 - DNA, 23 bp, Nilaparvata lugens
agcaactacaacttcgagaagcc

SEQ ID NO: 1323 - DNA, 29 bp, Nilaparvata lugens
aagctgatcggtgaccccaacctggagtt

SEQ ID NO: 1324 - DNA, 22 bp, Nilaparvata lugens
cacagtttgaacagcaagctgg

SEQ ID NO: 1325 - DNA, 24 bp, Nilaparvata lugens
gcagcagacgcaggcacaggtaga

SEQ ID NO: 1326 - DNA, 22 bp, Nilaparvata lugens
cacagtttgaacagcaagctgg

SEQ ID NO: 1327 - DNA, 23 bp, Nilaparvata lugens
caagcgaagatgttggacatgct

SEQ ID NO: 1328 - DNA, 29 bp, Nilaparvata lugens
atggtggtgggctggtaccactcgcaccc

SEQ ID NO: 1329 - DNA, 26 bp, Nilaparvata lugens
gtggtgggctggtaccactcgcaccc

SEQ ID NO: 1330 - DNA, 23 bp, Nilaparvata lugens
gtgggctggtaccactcgcaccc

SEQ ID NO: 1331 - DNA, 29 bp, Nilaparvata lugens
aagatgttggacatgctaaagcagacagg

SEQ ID NO: 1332 - DNA, 22 bp, Nilaparvata lugens
tgtcgggtgtcgacatcaacac

SEQ ID NO: 1333 - DNA, 21 bp, Nilaparvata lugens
gttcccatggaagttatgggc

SEQ ID NO: 1334 - DNA, 23 bp, Nilaparvata lugens
gtgggctggtaccactcgcaccc

SEQ ID NO: 1335 - DNA, 23 bp, Nilaparvata lugens
gagatcgatgccaaggccgagga

SEQ ID NO: 1336 - DNA, 21 bp, Nilaparvata lugens
gaattcaacattgaaaaggga

SEQ ID NO: 1337 - DNA, 23 bp, Nilaparvata lugens
gaagaattcaacattgaaaaggg

SEQ ID NO: 1338 - DNA, 23 bp, Nilaparvata lugens
gaagccaatgagaaagccgaaga

SEQ ID NO: 1339 - DNA, 23 bp, Nilaparvata lugens
tcgtcaaacatgctgaaccaagc

SEQ ID NO: 1340 - DNA, 24 bp, Nilaparvata lugens
tttcattgagcaagaagccaatga

SEQ ID NO: 1341 - DNA, 23 bp, Nilaparvata lugens
caagaagccaatgagaaagccga

SEQ ID NO: 1342 - DNA, 24 bp, Nilaparvata lugens
tttcattgagcaagaagccaatga

SEQ ID NO: 1343 - DNA, 21 bp, Nilaparvata lugens
agaagccaatgagaaagccga

SEQ ID NO: 1344 - DNA, 23 bp, Nilaparvata lugens
tcgtcaaacatgctgaaccaagc

SEQ ID NO: 1345 - DNA, 32 bp, Nilaparvata lugens
gccaatgagaaagccgaagagatcgatgccaa

SEQ ID NO: 1346 - DNA, 23 bp, Nilaparvata lugens
aaagccgaagagatcgatgccaa

SEQ ID NO: 1347 - DNA, 23 bp, Nilaparvata lugens
gagatcgatgccaaggccgagga

SEQ ID NO: 1348 - DNA, 23 bp, Nilaparvata lugens
gaagaattcaacattgaaaaggg

SEQ ID NO: 1349 - DNA, 29 bp, Nilaparvata lugens
gaagaattcaacattgaaaagggaaggct

SEQ ID NO: 1350 - DNA, 22 bp, Nilaparvata lugens
aagaattcaacattgaaaaggg

SEQ ID NO: 1351 - DNA, 23 bp, Nilaparvata lugens
gaggtgctgcgcatccacaccaa

SEQ ID NO: 1352 - DNA, 23 bp, Nilaparvata lugens
atccatgtgctgcccattgatga

SEQ ID NO: 1353 - DNA, 21 bp, Nilaparvata lugens
catgtgctgcccattgatgat

SEQ ID NO: 1354 - DNA, 31 bp, Nilaparvata lugens
ctgcgcatccacaccaagaacatgaagttgg

SEQ ID NO: 1355 - DNA, 23 bp, Nilaparvata lugens
ttcttcttcctcatcaacggacc

SEQ ID NO: 1356 - DNA, 21 bp, Nilaparvata lugens
gagatggtggagttgccgctg

SEQ ID NO: 1357 - DNA, 21 bp, Nilaparvata lugens
cagatcaaagagatggtggag

SEQ ID NO: 1358 - DNA, 21 bp, Nilaparvata lugens
atcaacggacccgagattatg

SEQ ID NO: 1359 - DNA, 23 bp, Nilaparvata lugens
atgaagatgatggccggtgcgtt

SEQ ID NO: 1360 - DNA, 24 bp, Nilaparvata lugens
ccggccatcatcttcatcgatgag

SEQ ID NO: 1361 - DNA, 26 bp, Nilaparvata lugens
atcatcttcatcgatgagctggacgc

SEQ ID NO: 1362 - DNA, 23 bp, Nilaparvata lugens
cagctgctgacgctgatggacgg

SEQ ID NO: 1363 - DNA, 29 bp, Nilaparvata lugens
atcgacattggcattcccgatgccaccgg

SEQ ID NO: 1364 - DNA, 30 bp, Nilaparvata lugens
tctatggagaacgtgtgcctgttcttgaac

SEQ ID NO: 1365 - DNA, 23 bp, Nilaparvata lugens
taccagtgcgagaagcacgtgct

SEQ ID NO: 1366 - DNA, 32 bp, Nilaparvata lugens
atggagaacgtgtgcctgttcttgaacctggc

SEQ ID NO: 1367 - DNA, 23 bp, Nilaparvata lugens
cgtggccagaaaatccccatctt

SEQ ID NO: 1368 - DNA, 26 bp, Nilaparvata lugens
tggcctaccagtgcgagaagcacgtg

SEQ ID NO: 1369 - DNA, 25 bp, Nilaparvata lugens
tggccaccatctacgagcgcgccgg

SEQ ID NO: 1370 - DNA, 26 bp, Nilaparvata lugens
atggagaacgtgtgcctgttcttgaa

SEQ ID NO: 1371 - DNA, 23 bp, Nilaparvata lugens
cccgaggaaatgatccagactgg

SEQ ID NO: 1372 - DNA, 28 bp, Nilaparvata lugens
tggcctaccagtgcgagaagcacgtgct

SEQ ID NO: 1373 - DNA, 48 bp, Nilaparvata lugens
gaggaggtgcccggccgtcgtggtttccccggttacatgtacaccgat

SEQ ID NO: 1374 - DNA, 23 bp, Nilaparvata lugens
gagggtcgcaacggctccatcac

SEQ ID NO: 1375 - DNA, 45 bp, Nilaparvata lugens
gaggtgcccggccgtcgtggtttccccggttacatgtacaccgat

SEQ ID NO: 1376 - DNA, 27 bp, Nilaparvata lugens
atggagaacgtgtgcctgttcttgaac

SEQ ID NO: 1377 - DNA, 37 bp, Nilaparvata lugens
tggcctaccagtgcgagaagcacgtgctcgtcatcct

SEQ ID NO: 1378 - DNA, 33 bp, Nilaparvata lugens
cgtcgtggtttccccggttacatgtacaccgat

SEQ ID NO: 1379 - DNA, 35 bp, Nilaparvata lugens
tggtcgcgtatctatcccgaggaaatgatccagac

SEQ ID NO: 1380 - DNA, 38 bp, Nilaparvata lugens
tggtcgcgtatctatcccgaggaaatgatccagactgg

SEQ ID NO: 1381 - DNA, 30 bp, Nilaparvata lugens; identical to SEQ ID NO: 1364

SEQ ID NO: 1382 - DNA, 27 bp, Nilaparvata lugens
atggagaacgtgtgcctgttcttgaac

SEQ ID NO: 1383 - DNA, 21 bp, Nilaparvata lugens
aacgtgtgcctgttcttgaac

SEQ ID NO: 1384 - DNA, 28 bp, Nilaparvata lugens
tggcctaccagtgcgagaagcacgtgct

SEQ ID NO: 1385 - DNA, 37 bp, Nilaparvata lugens; identical to SEQ ID NO: 1377

SEQ ID NO: 1386 - DNA, 26 bp, Nilaparvata lugens
gcctaccagtgcgagaagcacgtgct

SEQ ID NO: 1387 - DNA, 44 bp, Nilaparvata lugens
gaggaggtgcccggccgtcgtggtttccccggttacatgtacac

SEQ ID NO: 1388 - DNA, 48 bp, Nilaparvata lugens; identical to SEQ ID NO: 1373

SEQ ID NO: 1389 - DNA, 45 bp, Nilaparvata lugens; identical to SEQ ID NO: 1375

SEQ ID NO: 1390 - DNA, 23 bp, Nilaparvata lugens
cgtcgtggtttccccggttacat

SEQ ID NO: 1391 - DNA, 33 bp, Nilaparvata lugens; identical to SEQ ID NO: 1378

SEQ ID NO: 1392 - DNA, 30 bp, Nilaparvata lugens
cgtggtttccccggttacatgtacaccgat

SEQ ID NO: 1393 - DNA, 28 bp, Nilaparvata lugens
atcggtgtacatgtaaccggggaaacca

SEQ ID NO: 1394 - DNA, 23 bp, Nilaparvata lugens
cgtccggcgcgctcgtagatggt

SEQ ID NO: 1395 - DNA, 23 bp, Nilaparvata lugens
gagggtcgcaacggctccatcac

SEQ ID NO: 1396 - DNA, 21 bp, Nilaparvata lugens
cggacgtggcctggttcatca

SEQ ID NO: 1397 - DNA, 39 bp, Nilaparvata lugens
gtggtgtacgactgcaccgaccaggagtcgttcaacaac

SEQ ID NO: 1398 - DNA, 26 bp, Nilaparvata lugens
gaaagttacatcagtaccattggtgt

SEQ ID NO: 1399 - DNA, 25 bp, Nilaparvata lugens
caccgaccaggagtcgttcaacaac

SEQ ID NO: 1400 - DNA, 26 bp, Nilaparvata lugens
agtaccattggtgtagattttaaaat

SEQ ID NO: 1401 - DNA, 23 bp, Nilaparvata lugens
attggtgtagattttaaaattag

SEQ ID NO: 1402 - DNA, 23 bp, Nilaparvata lugens
ggtgtagattttaaaattagaac

SEQ ID NO: 1403 - DNA, 26 bp, Nilaparvata lugens
ggtgtagattttaaaattagaacaat

SEQ ID NO: 1404 - DNA, 22 bp, Nilaparvata lugens
gttctaattttaaaatctacac

SEQ ID NO: 1405 - DNA, 21 bp, Nilaparvata lugens
tgggacacggccggccaggag

SEQ ID NO: 1406 - DNA, 23 bp, Nilaparvata lugens
tgggacacggccggccaggagcg

SEQ ID NO: 1407 - DNA, 25 bp, Nilaparvata lugens
tgggacacggccggccaggagcggt

SEQ ID NO: 1408 - DNA, 23 bp, Nilaparvata lugens
gaccagctgggcattccgttcct

SEQ ID NO: 1409 - DNA, 21 bp, Nilaparvata lugens
attggtgtagattttaaaatt

SEQ ID NO: 1410 - DNA, 26 bp, Nilaparvata lugens
tgggacacggccggccaggagcggtt

SEQ ID NO: 1411 - DNA, 23 bp, Nilaparvata lugens
caggagcggttccgcacgatcac

SEQ ID NO: 1412 - DNA, 26 bp, Nilaparvata lugens
attggtgtagattttaaaattagaac

SEQ ID NO: 1413 - DNA, 23 bp, Nilaparvata lugens
attggtgtagattttaaaattag

SEQ ID NO: 1414 - DNA, 21 bp, Nilaparvata lugens
tgggacacggccggccaggag

SEQ ID NO: 1415 - DNA, 25 bp, Nilaparvata lugens
tgggacacggccggccaggagcggt

SEQ ID NO: 1416 - DNA, 32 bp, Nilaparvata lugens
gatgacacatacacagaaagttacatcagtac

SEQ ID NO: 1417 - DNA, 23 bp, Nilaparvata lugens
acggccggccaggagcggttccg

SEQ ID NO: 1418 - DNA, 26 bp, Nilaparvata lugens
agtaccattggtgtagattttaaaat

SEQ ID NO: 1419 - DNA, 22 bp, Nilaparvata lugens
taaagcttcagatttgggacac

SEQ ID NO: 1420 - DNA, 23 bp, Nilaparvata lugens
atttgggacacggccggccagga

SEQ ID NO: 1421 - DNA, 39 bp, Nilaparvata lugens; identical to SEQ ID NO: 1397

SEQ ID NO: 1422 - DNA, 26 bp, Nilaparvata lugens
ggtgtagattttaaaattagaacaat

SEQ ID NO: 1423 - DNA, 23 bp, Nilaparvata lugens
tgggacacggccggccaggagcg

SEQ ID NO: 1424 - DNA, 25 bp, Nilaparvata lugens
tcttcctcaccggtcaggaggagat

SEQ ID NO: 1425 - DNA, 26 bp, Nilaparvata lugens
aaattctccgagtttttcgacgatgc

SEQ ID NO: 1426 - DNA, 23 bp, Nilaparvata lugens
ttcctcaccggtcaggaggagat

SEQ ID NO: 1427 - DNA, 25 bp, Nilaparvata lugens
tagtattggccacaaatattgcaga

SEQ ID NO: 1428 - DNA, 23 bp, Nilaparvata lugens
tatttgaacatatgggtgccgca

SEQ ID NO: 1429 - DNA, 23 bp, Nilaparvata lugens
gagggagaggaaatgtggaatcc

SEQ ID NO: 1430 - DNA, 22 bp, Nilaparvata lugens
ccgaagattgtctgtatttgaa

SEQ ID NO: 1431 - DNA, 21 bp, Nilaparvata lugens
gattccgtttgcgaaacctcc

SEQ ID NO: 1432 - DNA, 23 bp, Nilaparvata lugens
ggtgcgttcggcttcctctacct

SEQ ID NO: 1433 - DNA, 21 bp, Nilaparvata lugens
caattcaatgctagggaaagg

SEQ ID NO: 1434 - DNA, 23 bp, Nilaparvata lugens
gagggagaggaaatgtggaatcc

SEQ ID NO: 1435 - DNA, 22 bp, Nilaparvata lugens
ccgaagattgtctgtatttgaa

SEQ ID NO: 1436 - DNA, 23 bp, Nilaparvata lugens
gacgtcatcgtcgcctccatgca

SEQ ID NO: 1437 - DNA, 21 bp, Nilaparvata lugens
ggagaccctggagctggtgcg

SEQ ID NO: 1438 - DNA, 24 bp, Nilaparvata lugens
agtacaagctgtgcaaagtgaaga

SEQ ID NO: 1439 - DNA, 24 bp, Nilaparvata lugens
atggatgttggacaaattgggtgg

SEQ ID NO: 1440 - DNA, 23 bp, Nilaparvata lugens
tggatgttggacaaattgggtgg

SEQ ID NO: 1441 - DNA, 24 bp, Nilaparvata lugens
agtacaagctgtgcaaagtgaaga

SEQ ID NO: 1442 - DNA, 22 bp, Nilaparvata lugens
agtccatccatcacgcccgtgt

SEQ ID NO: 1443 - DNA, 24 bp, Nilaparvata lugens
ctccgtaacaagcgtgaggtgtgg

SEQ ID NO: 1444 - DNA, 26 bp, Nilaparvata lugens
gactcgcagaagcacattgacttctc

SEQ ID NO: 1445 - DNA, 21 bp, Nilaparvata lugens
gcagaagcacattgacttctc

SEQ ID NO: 1446 - DNA, 22 bp, Nilaparvata lugens
gccaagtccatccatcacgccc

SEQ ID NO: 1447 - DNA, 26 bp, Nilaparvata lugens
gccaagtccatccatcacgcccgtgt

SEQ ID NO: 1448 - DNA, 23 bp, Nilaparvata lugens
tcgcagaagcacattgacttctc

SEQ ID NO: 1449 - DNA, 29 bp, Nilaparvata lugens
tcgcagaagcacattgacttctcgctgaa

SEQ ID NO: 1450 - DNA, 26 bp, Nilaparvata lugens
gccaagtccatccatcacgcccgtgt

SEQ ID NO: 1451 - DNA, 26 bp, Nilaparvata lugens
gactcgcagaagcacattgacttctc

SEQ ID NO: 1452 - DNA, 24 bp, Nilaparvata lugens
ctccgtaacaagcgtgaggtgtgg

SEQ ID NO: 1453 - DNA, 23 bp, Nilaparvata lugens
aagaacaaggatattcgtaaatt

SEQ ID NO: 1454 - DNA, 29 bp, Nilaparvata lugens
aagaacaaggatattcgtaaattcttgga

SEQ ID NO: 1455 - DNA, 26 bp, Nilaparvata lugens
ccgtgtacgcccatttccccatcaac

SEQ ID NO: 1456 - DNA, 21 bp, Nilaparvata lugens
tacgcccatttccccatcaac

SEQ ID NO: 1457 - DNA, 23 bp, Nilaparvata lugens
caacatgaatgcattcctcaagc

SEQ ID NO: 1458 - DNA, 23 bp, Nilaparvata lugens
gaagtacaacatgaatgcattcc

SEQ ID NO: 1459 - DNA, 21 bp, Nilaparvata lugens
gctgtatttgtgttggcgaca

SEQ ID NO: 1460 - DNA, 21 bp, Nilaparvata lugens
agaaaaggttgtgggttggta

SEQ ID NO: 1461 - DNA, 35 bp, Nilaparvata lugens
ggacttcgtgatggatattacattcagggacaatg

SEQ ID NO: 1462 - DNA, 21 bp, Nilaparvata lugens
caactacaacttcgagaagcc

SEQ ID NO: 1463 - DNA, 23 bp, Nilaparvata lugens
gaagaattcaacattgaaaaggg

SEQ ID NO: 1464 - DNA, 23 bp, Nilaparvata lugens
gagcaagaagccaatgagaaagc

SEQ ID NO: 1465 - DNA, 36 bp, Nilaparvata lugens
tttcattgagcaagaagccaatgagaaagccgaaga

SEQ ID NO: 1466 - DNA, 27 bp, Nilaparvata lugens
atgagcaaattggccggcgagtcggag

SEQ ID NO: 1467 - DNA, 26 bp, Nilaparvata lugens
cacaccaagaacatgaagttggctga

SEQ ID NO: 1468 - DNA, 21 bp, Nilaparvata lugens
caggaaatctgttcgaagtgt

SEQ ID NO: 1469 - DNA, 23 bp, Nilaparvata lugens
ctggcgcagatcaaagagatggt

SEQ ID NO: 1470 - DNA, 22 bp, Nilaparvata lugens
tggcgcagatcaaagagatggt

SEQ ID NO: 1471 - DNA, 23 bp, Nilaparvata lugens
tatcccgaggaaatgatccagac

SEQ ID NO: 1472 - DNA, 38 bp, Nilaparvata lugens
cgtatctatcccgaggaaatgatccagactggaatttc

SEQ ID NO: 1473 - DNA, 21 bp, Nilaparvata lugens
tggatgggagtcatgcatgga

SEQ ID NO: 1474 - DNA, 24 bp, Nilaparvata lugens
ccaagggcaagggtgtgaagctca

SEQ ID NO: 1475 - DNA, 23 bp, Nilaparvata lugens
tctctgcccaagggcaagggtgt

SEQ ID NO: 1476 - DNA, 21 bp, Nilaparvata lugens
tctgcccaagggcaagggtgt

SEQ ID NO: 1477 - DNA, 21 bp, Nilaparvata lugens
tctctgcccaagggcaagggt

SEQ ID NO: 1478 - DNA, 23 bp, Nilaparvata lugens
tctctgcccaagggcaagggtgt

SEQ ID NO: 1479 - DNA, 24 bp, Nilaparvata lugens
ctgcccaagggcaagggtgtgaag

SEQ ID NO: 1480 - DNA, 22 bp, Nilaparvata lugens
atgaagctcgattacgtcttgg

SEQ ID NO: 1481 - DNA, 21 bp, Nilaparvata lugens
cgtaaggccgctcgtgagctg

SEQ ID NO: 1482 - DNA, 26 bp, Nilaparvata lugens
cgtaaggccgctcgtgagctgttgac

SEQ ID NO: 1483 - DNA, 23 bp, Nilaparvata lugens
gactcgcagaagcacattgactt

SEQ ID NO: 1484 - DNA, 21 bp, Nilaparvata lugens
tgaagctcgattacgtcttgg

SEQ ID NO: 1485 - DNA, 28 bp, Nilaparvata lugens
tggccaagtccatccatcacgcccgtgt

SEQ ID NO: 1486 - DNA, 21 bp, Nilaparvata lugens
cgtaacttcctgggcgagaag

SEQ ID NO: 1487 - DNA, 22 bp, Nilaparvata lugens
atgaagctcgattacgtcttgg

SEQ ID NO: 1488 - DNA, 22 bp, Nilaparvata lugens
tcggtttggccaagtccatcca

SEQ ID NO: 1489 - DNA, 23 bp, Nilaparvata lugens
gactcgcagaagcacattgactt

SEQ ID NO: 1490 - DNA, 26 bp, Nilaparvata lugens
gactcgcagaagcacattgacttctc

SEQ ID NO: 1491 - DNA, 21 bp, Nilaparvata lugens
tacgcccatttccccatcaac

SEQ ID NO: 1492 - DNA, 25 bp, Nilaparvata lugens
cgtgtacgcccatttccccatcaac

SEQ ID NO: 1493 - DNA, 21 bp, Nilaparvata lugens
tacgcccatttccccatcaac

SEQ ID NO: 1494 - DNA, 23 bp, Nilaparvata lugens
tacgcccatttccccatcaactg

SEQ ID NO: 1495 - DNA, 25 bp, Nilaparvata lugens
cgtgtacgcccatttccccatcaac

SEQ ID NO: 1496 - DNA, 21 bp, Nilaparvata lugens
aaaaggtcaaggaggccaaga

SEQ ID NO: 1497 - DNA, 26 bp, Nilaparvata lugens
ttcaagaacaagcgtgtattgatgga

SEQ ID NO: 1498 - DNA, 28 bp, Nilaparvata lugens
ttcaagaacaagcgtgtattgatggagt

SEQ ID NO: 1499 - DNA, 21 bp, Nilaparvata lugens
cctggaggaggagacgaccat

SEQ ID NO: 1500 - DNA, 22 bp, Nilaparvata lugens
tcccatctcgtatgacaattgg

SEQ ID NO: 1501 - DNA, 21 bp, Nilaparvata lugens
atggtcgtctcctcctccagg

SEQ ID NO: 1502 - DNA, 22 bp, Nilaparvata lugens
tcccatctcgtatgacaattgg

SEQ ID NO: 1503 - DNA, 23 bp, Nilaparvata lugens
caagtcatgatgttcagtgcaac

SEQ ID NO: 1504 - DNA, 23 bp, Nilaparvata lugens
tgacgcttcacggcctgcagcag

SEQ ID NO: 1505 - DNA, 23 bp, Nilaparvata lugens
caagtcatgatgttcagtgcaac

SEQ ID NO: 1506 - DNA, 23 bp, Nilaparvata lugens
caattcttgcaagtgttcaacaa

SEQ ID NO: 1507 - DNA, 23 bp, Nilaparvata lugens
ttcaacaacagtcctgatgaaac

SEQ ID NO: 1508 - DNA, 21 bp, Nilaparvata lugens
ttcttgcaagtgttcaacaac

SEQ ID NO: 1509 - DNA, 21 bp, Nilaparvata lugens
aagaacgttcccaactggcac

SEQ ID NO: 1510 - DNA, 22 bp, Nilaparvata lugens
acaagaacgttcccaactggca

SEQ ID NO: 1511 - DNA, 22 bp, Nilaparvata lugens
acctacaagaacgttcccaact

SEQ ID NO: 1512 - DNA, 27 bp, Nilaparvata lugens
acctacaagaacgttcccaactggcac

SEQ ID NO: 1513 - DNA, 21 bp, Nilaparvata lugens
caactacaacttcgagaagcc

SEQ ID NO: 1514 - DNA, 22 bp, Nilaparvata lugens
caagaacgttcccaactggcac

SEQ ID NO: 1515 - DNA, 22 bp, Nilaparvata lugens
cacctacaagaacgttcccaac

SEQ ID NO: 1516 - DNA, 22 bp, Nilaparvata lugens
cctacaagaacgttcccaactg

SEQ ID NO: 1517 - DNA, 22 bp, Nilaparvata lugens
ctacaagaacgttcccaactgg

SEQ ID NO: 1518 - DNA, 22 bp, Nilaparvata lugens
gcaactacaacttcgagaagcc

SEQ ID NO: 1519 - DNA, 22 bp, Nilaparvata lugens
tacaagaacgttcccaactggc

SEQ ID NO: 1520 - DNA, 21 bp, Nilaparvata lugens
tcacctacaagaacgttccca

SEQ ID NO: 1521 - DNA, 22 bp, Nilaparvata lugens
tcacctacaagaacgttcccaa

SEQ ID NO: 1522 - DNA, 24 bp, Nilaparvata lugens
tcacctacaagaacgttcccaact

SEQ ID NO: 1523 - DNA, 29 bp, Nilaparvata lugens
tcacctacaagaacgttcccaactggcac

SEQ ID NO: 1524 - DNA, 22 bp, Nilaparvata lugens
tgggacacagctggccaggaaa

SEQ ID NO: 1525 - DNA, 21 bp, Nilaparvata lugens
ttcgagaagccgttcctgtgg

SEQ ID NO: 1526 - DNA, 26 bp, Nilaparvata lugens
ttcgagaagccgttcctgtggttggc

SEQ ID NO: 1527 - DNA, 22 bp, Nilaparvata lugens
tgggacacagctggccaggaaa

SEQ ID NO: 1528 - DNA, 22 bp, Nilaparvata lugens
tattacattcagggacaatgcg

SEQ ID NO: 1529 - DNA, 29 bp, Nilaparvata lugens
tcacctacaagaacgttcccaactggcac

SEQ ID NO: 1530 - DNA, 27 bp, Nilaparvata lugens
acctacaagaacgttcccaactggcac

SEQ ID NO: 1531 - DNA, 23 bp, Nilaparvata lugens
tacaagaacgttcccaactggca

SEQ ID NO: 1532 - DNA, 24 bp, Nilaparvata lugens
tacaagaacgttcccaactggcac

SEQ ID NO: 1533 - DNA, 22 bp, Nilaparvata lugens
aggaagaagaaccttcagtact

SEQ ID NO: 1534 - DNA, 23 bp, Nilaparvata lugens
aagaagaaccttcagtactacga

SEQ ID NO: 1535 - DNA, 27 bp, Nilaparvata lugens
aagaagaaccttcagtactacgacatc

SEQ ID NO: 1536 - DNA, 24 bp, Nilaparvata lugens
aagaaccttcagtactacgacatc

SEQ ID NO: 1537 - DNA, 22 bp, Nilaparvata lugens
ggcttctcgaagttgtagttgc

SEQ ID NO: 1538 - DNA, 21 bp, Nilaparvata lugens
caactacaacttcgagaagcc

SEQ ID NO: 1539 - DNA, 21 bp, Nilaparvata lugens
ggcttctcgaagttgtagttg

SEQ ID NO: 1540 - DNA, 26 bp, Nilaparvata lugens
cccgagatggtggtgggctggtacca

SEQ ID NO: 1541 - DNA, 22 bp, Nilaparvata lugens
ggtaccactcgcacccgggctt

SEQ ID NO: 1542 - DNA, 47 bp, Nilaparvata lugens
gtgggctggtaccactcgcacccgggcttcggctgctggctgtcggg

SEQ ID NO: 1543 - DNA, 23 bp, Nilaparvata lugens
tggtaccactcgcacccgggctt

SEQ ID NO: 1544 - DNA, 26 bp, Nilaparvata lugens
cccgagatggtggtgggctggtacca

SEQ ID NO: 1545 - DNA, 21 bp, Nilaparvata lugens
atccacaccaagaacatgaag

SEQ ID NO: 1546 - DNA, 22 bp, Nilaparvata lugens
cacaccaagaacatgaagttgg

SEQ ID NO: 1547 - DNA, 23 bp, Nilaparvata lugens
gccttcttcttcctcatcaacgg

SEQ ID NO: 1548 - DNA, 22 bp, Nilaparvata lugens
ttggaggctgcagaaagcagct

SEQ ID NO: 1549 - DNA, 23 bp, Nilaparvata lugens
gccttcttcttcctcatcaacgg

SEQ ID NO: 1550 - DNA, 21 bp, Nilaparvata lugens
atccacaccaagaacatgaag

SEQ ID NO: 1551 - DNA, 23 bp, Nilaparvata lugens
cacaccaagaacatgaagttggc

SEQ ID NO: 1552 - DNA, 21 bp, Nilaparvata lugens
catgaactcgattgctcgtgg

SEQ ID NO: 1553 - DNA, 25 bp, Nilaparvata lugens
ccaccatctacgagcgcgccggacg

SEQ ID NO: 1554 - DNA, 21 bp, Nilaparvata lugens
catgaactcgattgctcgtgg

SEQ ID NO: 1555 - DNA, 21 bp, Nilaparvata lugens
catgtcggtgaggatgacgag

SEQ ID NO: 1556 - DNA, 25 bp, Nilaparvata lugens
ccaccatctacgagcgcgccggacg

SEQ ID NO: 1557 - DNA, 29 bp, Nilaparvata lugens
cagatttgggacacggccggccaggagcg

SEQ ID NO: 1558 - DNA, 21 bp, Nilaparvata lugens
gaccaggagtcgttcaacaac

SEQ ID NO: 1559 - DNA, 21 bp, Nilaparvata lugens
tgggacacggccggccaggag

SEQ ID NO: 1560 - DNA, 23 bp, Nilaparvata lugens
tgggacacggccggccaggagcg

SEQ ID NO: 1561 - DNA, 26 bp, Nilaparvata lugens
tgggacacggccggccaggagcggtt

SEQ ID NO: 1562 - DNA, 26 bp, Nilaparvata lugens
ttcctggagacgtcggcgaagaacgc

SEQ ID NO: 1563 - DNA, 29 bp, Nilaparvata lugens
cagatttgggacacggccggccaggagcg

SEQ ID NO: 1564 - DNA, 21 bp, Nilaparvata lugens
tgggacacggccggccaggag

SEQ ID NO: 1565 - DNA, 23 bp, Nilaparvata lugens
tgggacacggccggccaggagcg

SEQ ID NO: 1566 - DNA, 26 bp, Nilaparvata lugens
tgggacacggccggccaggagcggtt

SEQ ID NO: 1567 - DNA, 29 bp, Nilaparvata lugens
tgggacacggccggccaggagcggttccg

SEQ ID NO: 1568 - DNA, 22 bp, Nilaparvata lugens
caggcaaagattttcctgccca

SEQ ID NO: 1569 - DNA, 23 bp, Nilaparvata lugens
ggcaagtgcttccgtctgtacac

SEQ ID NO: 1570 - DNA, 21 bp, Nilaparvata lugens
ggatgaccaaaaacgtattct

SEQ ID NO: 1571 - DNA, 21 bp, Nilaparvata lugens
agaatacgtttttggtcatcc

SEQ ID NO: 1572 - DNA, 697 bp, Nilaparvata lugens
gaaatcatggatgttggacaaattgggtggtgtgtatgcaccccgacccagcacaggtccacacaagctgcgagaatctctcccacttgtcatatttttgcgtaatcggctcaagtacgctttaactaactgtgaagtgaagaaaattgtgatgcagcgtctcatcaaggttgacggcaaagtgaggactgaccccaactatcctgcaggttttatggacgttgttcaaatcgaaaagacaaacgagttcttccgtttgatctatgatgttaagggacgtttcaccatccacaggatcacagctgaagaagctaagtacaagctgtgcaaagtgaagagggttcagacaggacccaagggcattccatttttgaccactcacgatggacgcaccatcaggtatccagaccccttagtaaaagtcaatgacaccatccaattggacattgccacatccaaaatcatggacttcatcagattcgactctggtaacctgtgtatgatcactggaggtcgtaacttgggtcgtgtgggcactgtcgtgaacagggagcgacacccggggtctttcgacatcgtgcacatcaaggacgtgttgggacacacttttgccactaggttgaacaacgttttcatcatcggcaagggtagtaaagcatacgtgtctctgcccaagggcaagggtgtgaagctcagt

SEQ ID NO: 1573 - DNA, 48 bp, Artificial Sequence
  synthetic oligo
gcgtaatacgactcactatagggaaatcatggatgttggacaaattgg

SEQ ID NO: 1574 - DNA, 22 bp, Artificial Sequence
  synthetic oligo
actgagcttcacacccttgccc

SEQ ID NO: 1575 - DNA, 26 bp, Artificial Sequence
  synthetic oligo
gaaatcatggatgttggacaaattgg

SEQ ID NO: 1576 - DNA, 44 bp, Artificial Sequence
  synthetic oligo
gcgtaatacgactcactataggactgagcttcacacccttgccc

SEQ ID NO: 1577 - DNA, 336 bp, Nilaparvata lugens; identical to SEQ ID NO: 1073

SEQ ID NO: 1578 - DNA, 46 bp, Artificial Sequence
  synthetic oligo
gcgtaatacgactcactatagggatgaaaagggccctacaactggc

SEQ ID NO: 1579 - DNA, 26 bp, Artificial Sequence
  synthetic oligo
ctgatccacatccatgtgttgatgag

SEQ ID NO: 1580 - DNA, 24 bp, Artificial Sequence
  synthetic oligo
gatgaaaagggccctacaactggc

SEQ ID NO: 1581 - DNA, 48 bp, Artificial Sequence
  synthetic oligo
gcgtaatacgactcactataggctgatccacatccatgtgttgatgag

SEQ ID NO: 1582 - DNA, 477 bp, Nilaparvata lugens; identical to SEQ ID NO: 1075

SEQ ID NO: 1583 - DNA, 46 bp, Artificial Sequence
  synthetic oligo
gcgtaatacgactcactataggtccgcgtcgtccttacgagaaggc

SEQ ID NO: 1584 - DNA, 22 bp, Artificial Sequence
  synthetic oligo
ttgacgcgaccaggtcggccac

SEQ ID NO: 1585 - DNA, 24 bp, Artificial Sequence
  synthetic oligo
tccgcgtcgtccttacgagaaggc

SEQ ID NO: 1586 - DNA, 44 bp, Artificial Sequence
  synthetic oligo
gcgtaatacgactcactataggttgacgcgaccaggtcggccac

SEQ ID NO: 1587 - DNA, 305 bp, Nilaparvata lugens
ggagttggctgctgtaagaactgtctgctctcacatcgaaaacatgctgaagggagtcacaaagggattcctgtacaagatgcgtgccgtgtacgcccatttccccatcaactgtgtgacgaccgagaacaactctgtgatcgaggtgcgtaacttcctgggcgagaagtacatccgacgggtgaggatggcgcccggcgtcactgttaccaactcgacaaagcagaaggacgagctcatcgtcgaaggaaacagcatagaggacgtgtcaagatcagctgccctcatccaacagtcaacaacag

SEQ ID NO: 1588 - DNA, 45 bp, Artificial Sequence
  synthetic oligo
gcgtaatacgactcactataggggagttggctgctgtaagaactg

SEQ ID NO: 1589 - DNA, 23 bp, Artificial Sequence
  synthetic oligo
ctgttgttgactgttggatgagg

SEQ ID NO: 1590 - DNA, 23 bp, Artificial Sequence
  synthetic oligo
ggagttggctgctgtaagaactg

SEQ ID NO: 1591 - DNA, 45 bp, Artificial Sequence
  synthetic oligo
gcgtaatacgactcactataggctgttgttgactgttggatgagg

SEQ ID NO: 1592 - DNA, 424 bp, Nilaparvata lugens
cgcaaacacaaattcacgtcaaagcatcaggaagctgatcaaagacggtcttatcatcaagaaaccggttgcagtacattcacgtgctcgcgttcgtaaaaacactgaagccaggaggaaaggcagacattgtggctttggtaagaggaaaggtacagccaacgcccgtatgccacaaaaggttctatgggtgaatcgtatgcgtgtcttgagaagactgttgaaaaaatacagacaagataagaaaatcgacaggcatctgtaccatcacctttacatgaaggctaagggtaacgtattcaagaacaagcgtgtattgatggagttcattcataagaagaaggccgagaaagcaagaatgaagatgttgaacgaccaggctgaagctcgcagacaaaaggtcaaggaggccaagaagcgaagg

SEQ ID NO: 1593 - DNA, 47 bp, Artificial Sequence
  synthetic oligo
gcgtaatacgactcactataggcgcaaacacaaattcacgtcaaagc

SEQ ID NO: 1594 - DNA, 24 bp, Artificial Sequence
  synthetic oligo
ccttcgcttcttggcctccttgac

SEQ ID NO: 1595 - DNA, 25 bp, Artificial Sequence
  synthetic oligo
cgcaaacacaaattcacgtcaaagc

SEQ ID NO: 1596 - DNA, 46 bp, Artificial Sequence
  synthetic oligo
gcgtaatacgactcactataggccttcgcttcttggcctccttgac

SEQ ID NO: 1597 - DNA, 965 bp, Nilaparvata lugens
gtgcttgtgtcaagtggtgtggtggagtacattgacaccctggaggaggagacgaccatgatagcgatgtcgccggatgacctgcgtcaggacaaggagtatgcctactgtaccacctacacgcactgcgagatccacccggccatgatactcggtgtgtgcgcctctattattcccttccccgatcacaaccaaagtcccaggaacacctatcagagcgctatggggaaacaggcgatgggcgtgtacatcaccaacttccacgtgcgaatggacacgctggctcacgtgctgttctacccgcacaagccactggtcaccactcgctccatggagtacctgcgcttcagggagcttcctgccggcatcaactctgtggtcgccatcgcctgctacactggatacaaccaggaggacagtgtcattctcaacgcctccgctgtcgagcgcggattcttcagatcggttttcttccgatcttacaaagatgcagaatcgaagcgtattggcgaccaagaggagcaattcgagaagcccaccagacagacgtgtcagggaatgaggaatgccatttatgacaaattggacgatgatggcatcattgctcccggtctgagagtgtctggtgacgatgtggttattggcaaaaccataacactgcccgataatgatgacgagctggaaggtacaacaaagaggttcacgaagagagatgccagtactttcctgcgtaacagtgagacgggaatcgtcgaccaagtcatgttaaccttgaactctgagggttacaagttctgcaaaattcgagtcaggtctgtgcgtatcccgcagattggcgataagttcgcttcccgacatggccaaaaaggaacgtgtggaatacagtatcgtcaagaggacatgccttttacaagcgagggaatcgcaccggatattattatcaatcctcacgctatcccatctcg

SEQ ID NO: 1598 - DNA, 44 bp, Artificial Sequence
  synthetic oligo
gcgtaatacgactcactatagggtgcttgtgtcaagtggtgtgg

SEQ ID NO: 1599 - DNA, 20 bp, Artificial Sequence
  synthetic oligo
cgagatgggatagcgtgagg

SEQ ID NO: 1600 - DNA, 22 bp, Artificial Sequence
  synthetic oligo
gtgcttgtgtcaagtggtgtgg

SEQ ID NO: 1601 - DNA, 42 bp, Artificial Sequence
  synthetic oligo
gcgtaatacgactcactataggcgagatgggatagcgtgagg

SEQ ID NO: 1602 - DNA, 790 bp, Nilaparvata lugens
tgagagcaatccttgactgtggttttgaacatccatctgaagtacaacatgaatgcattcctcaagctgtacttggaatggacatattgtgtcaagcgaaatccggtatgggaaaaactgctgtatttgtgttggcgacattacagcaaattgaaccaactgacaaccaagtcagtgtattggtcatgtgtcataccagagagcttgcattccaaatcagcaaagagtatgaacgattttcgaaatgtatgccaaatatcaaggttggagttttcttcggcggactgccgattcagagggatgaggagacgttgaaattgaactgtcctcacatcgtggttggaacacccggacgaattttggcgttggtacgcaacaagaagctggacctcaagcatctcaagcactttgtccttgacgaatgtgacaaaatgttggaactgttagatatgcgaagagatgtgcaggaaatattccgaaacacgccgcacagcaaacaagtcatgatgttcagtgcaactctcagcaaagaaattcgtccagtctgcaagaaattcatgcaagatccgatggaagtgtacgttgatgacgaggccaagctgacgcttcacggcctgcagcagcactatgtcaaactcaaagaaaacgaaaagaacaaaaagttatttgaattacttgacatacttgaattcaaccaggttgttatatttgtgaagtcagtgcagcgctgcatggccctatcgcaactcctaacagagcagaacttccctgcagtggctattcaccgtgg

SEQ ID NO: 1603 - DNA, 44 bp, Artificial Sequence
  synthetic oligo
gcgtaatacgactcactataggtgagagcaatccttgactgtgg

SEQ ID NO: 1604 - DNA, 20 bp, Artificial Sequence
  synthetic oligo
ccacggtgaatagccactgc

SEQ ID NO: 1605 - DNA, 22 bp, Artificial Sequence
  synthetic oligo
tgagagcaatccttgactgtgg

SEQ ID NO: 1606 - DNA, 42 bp, Artificial Sequence
  synthetic oligo
gcgtaatacgactcactataggccacggtgaatagccactgc

SEQ ID NO: 1607 - DNA, 629 bp, Nilaparvata lugens
gatgctggagacctggaggtgtattagatgtttcaaacagttttgcagttccatttgatgaggacgacaaagaaaagaatgtttggttcttagaccatgattacttggaaaacatgttcgggatgttcaagaaagttaatgctagagaaaaggttgtgggttggtaccatactggacccaaactccaccaaaacgatgttgcaatcaatgagttgattcgtcgttactgtccaaactgtgtcttagtcataatcgatgccaagcctaaagatttgggtctacctacagaggcatacagagtcgttgaagaaatccatgatgatggatcgccaacatcaaaaacatttgaacatgtgatgagtgagattggggcagaagaggctgaggagattggcgttgaacatctgttgagagacatcaaagatacaacagtcgggtcactgtcacagcgcgtcacaaatcagctgatgggcttgaagggcttgcatctgcaattacaggatatgcgagactatttgaatcaggttgtcgaaggaaagttgccaatgaaccatcaaatcgtttaccaactgcaagacatcttcaaccttctacccgatatcggccacggcaattttgtagactcgctc

SEQ ID NO: 1608 - DNA, 43 bp, Artificial Sequence
  synthetic oligo
gcgtaatacgactcactatagggatgctggagacctggaggtg

SEQ ID NO: 1609 - DNA, 22 bp, Artificial Sequence
  synthetic oligo
gagcgagtctacaaaattgccg

SEQ ID NO: 1610 - DNA, 21 bp, Artificial Sequence
  synthetic oligo
gatgctggagacctggaggtg

SEQ ID NO: 1611 - DNA, 44 bp, Artificial Sequence
  synthetic oligo
gcgtaatacgactcactatagggagcgagtctacaaaattgccg

SEQ ID NO: 1612 - DNA, 355 bp, Nilaparvata lugens
gcgactatgatcgaccgccgggacgcggtcaggtgtgcgacgtcgacgtcaagaactggtttccctgcacctctgagaacaatttcaactaccatcaatcgagcccttgtgtttttctcaaactgaacaagataattggttggcaaccggagtactacaatgagactgaaggctttccagataatatgccaggtgacctcaagcgacacattgcccaacagaagagtatcaacaagctgtttatgcaaacaatctggataacttgcgaaggagagggtcctctagacaaggagaatgcaggggagatccagtacatccctagacagggatttccgggctacttctacccttacac

SEQ ID NO: 1613 - DNA, 41 bp, Artificial Sequence
  synthetic oligo
gcgtaatacgactcactatagggcgactatgatcgaccgcc

SEQ ID NO: 1614 - DNA, 23 bp, Artificial Sequence
  synthetic oligo
gtgtaagggtagaagtagcccgg

SEQ ID NO: 1615 - DNA, 19 bp, Artificial Sequence
  synthetic oligo
gcgactatgatcgaccgcc

SEQ ID NO: 1616 - DNA, 45 bp, Artificial Sequence
  synthetic oligo
gcgtaatacgactcactatagggtgtaagggtagaagtagcccgg

SEQ ID NO: 1617 - DNA, 711 bp, Nilaparvata lugens
gcttgttgttcccgttggatgtctgtatcaacctttgaaggagagacctgatctaccgcctgtacagtacgatccagttctttgtactaggaatacttgtcgtgcaattctgaatccattgtgccaagtcgactatcgagccaagctatgggtctgcaacttttgtttccagaggaatcctttcccccctcaatatgcagctatttcggagcagcatcaaccagcagaactgataccttcattttccaccatcgaatacatcattaccagagcgcaaacgatgccgccgatgttcgtgctggtggtggacacatgtctggacgacgaggagctgggagctttgaaggactcactgcagatgtcgctgtcgctgctgccgcccaatgcactcatcggtctcatcacgttcggcaaaatggtgcaggtgcacgagcttggctgcgacggctgctcgaagagctacgtgttccgtggcgtgaaggacctgactgccaagcagatccaggacatgttgggcattggcaagatggccgccgctccacagcccatgcaacagcgcattcccggcgccgctccctccgcacctgtcaacagatttcttcagcctgtcggaaagtgcgatatgagtttaactgatctgcttggggaattgcaaagagatccatggaatgtggctcagggcaagagacctctccgatctactggagttgc

SEQ ID NO: 1618 - DNA, 45 bp, Artificial Sequence
  synthetic oligo
gcgtaatacgactcactatagggcttgttgttcccgttggatgtc

SEQ ID NO: 1619 - DNA, 25 bp, Artificial Sequence
  synthetic oligo
gcaactccagtagatcggagaggtc

SEQ ID NO: 1620 - DNA, 23 bp, Artificial Sequence
  synthetic oligo
gcttgttgttcccgttggatgtc

SEQ ID NO: 1621 - DNA, 47 bp, Artificial Sequence
  synthetic oligo
gcgtaatacgactcactatagggcaactccagtagatcggagaggtc

SEQ ID NO: 1622 - DNA, 453 bp, Nilaparvata lugens
gttgccacccttggagttgaagttcacccccttgtatttcacacaaacagaggtgtgattaggttcaatgtgtgggacacagctggccaggaaaagttcggtggacttcgtgatggatattacattcagggacaatgcgccatcattatgtttgacgtaacgtcaagagtcacctacaagaacgttcccaactggcacagagatttagtgagggtttgcgaaaacattcccattgtactatgcggcaacaaagtagacatcaaggacaggaaagtcaaggccaagagcatagtcttccataggaagaagaaccttcagtactacgacatcagtgcgaaaagcaactacaacttcgagaagccgttcctgtggttggcaaagaagctgatcggtgaccccaacctggagttcgtcgccatgcccgccctcctcccacccgaggtcacaatggac

SEQ ID NO: 1623 - DNA, 26 bp, Artificial Sequence
  synthetic oligo
cccactttcaagtgygtrytrgtcgg

SEQ ID NO: 1624 - DNA, 21 bp, Artificial Sequence
  synthetic oligo
gtccattgtgacctcgggagg

SEQ ID NO: 1625 - DNA, 22 bp, Artificial Sequence
  synthetic oligo
gttgccacccttggagttgaag

SEQ ID NO: 1626 - DNA, 43 bp, Artificial Sequence
  synthetic oligo
gcgtaatacgactcactatagggtccattgtgacctcgggagg

SEQ ID NO: 1627 - DNA, 169 bp, Nilaparvata lugens; identical to SEQ ID NO: 1093

SEQ ID NO: 1628 - DNA, 45 bp, Artificial Sequence
  synthetic oligo
gcgtaatacgactcactatagggcagcagacgcaggcacaggtag

SEQ ID NO: 1629 - DNA, 27 bp, Artificial Sequence
  synthetic oligo
gaatttcctcttgagtttgccagcttg

SEQ ID NO: 1630 - DNA, 23 bp, Artificial Sequence
  synthetic oligo
gcagcagacgcaggcacaggtag

SEQ ID NO: 1631 - DNA, 49 bp, Artificial Sequence
  synthetic oligo
gcgtaatacgactcactatagggaatttcctcttgagtttgccagcttg

SEQ ID NO: 1632 - DNA, 346 bp, Nilaparvata lugens
cgcagagcaagtctacatctcttcactggccttattgaaaatgcttaagcacggtcgcgccggtgttcccatggaagttatgggcctaatgctgggcgaatttgtagacgactacactgtgcgtgtcattgatgtattcgctatgccacagagtggaacgggagtgagtgtggaggctgtagacccggtgttccaagcgaagatgttggacatgctaaagcagacaggacggcccgagatggtggtgggctggtaccactcgcacccgggcttcggctgctggctgtcgggtgtcgacatcaacacgcaggagagcttcgagcaactatccaagagagccgttgcc

SEQ ID NO: 1633 - DNA, 46 bp, Artificial Sequence
  synthetic oligo
gcgtaatacgactcactataggcgcagagcaagtctacatctcttc

SEQ ID NO: 1634 - DNA, 21 bp, Artificial Sequence
  synthetic oligo
ggcaacggctctcttggatag

SEQ ID NO: 1635 - DNA, 24 bp, Artificial Sequence
  synthetic oligo
cgcagagcaagtctacatctcttc

SEQ ID NO: 1636 - DNA, 43 bp, Artificial Sequence
  synthetic oligo
gcgtaatacgactcactataggggcaacggctctcttggatag

SEQ ID NO: 1637 - DNA, 592 bp, Nilaparvata lugens
cattgagcaagaagccaatgagaaagccgaagagatcgatgccaaggccgaggaagaattcaacattgaaaagggaaggctcgtacagcaccagcgccttaaaatcatggagtactatgacaggaaagagaagcaggttgagctccagaaaaaaatccaatcgtcaaacatgctgaaccaagcgcgtctgaaggcactgaaggtgcgcgaagatcacgtgagaagtgtgctcgaagaatccagaaaacgtcttggagaagtaaccagaaacccagccaagtacaaggaagtcctccagtatctaattgtccaaggactcctgcagctgctagaatcaaacgtagtactgcgcgtgcgcgaggctgacgtgagtctgatcgagggcattgttggctcatgcgcagagcagtacgcgaagatgaccggcaaagaggtggtggtgaagctggacgctgacaacttcctggccgccgagacgtgtggaggcgtcgagttgttcgcccgcaacggccgcatcaagatccccaacaccctcgagtccaggctcgacctcatctcccagcaacttgtgcccgagattagagtcgcgctc

SEQ ID NO: 1638 - DNA, 44 bp, Artificial Sequence
  synthetic oligo
gcgtaatacgactcactataggcattgagcaagaagccaatgag

SEQ ID NO: 1639 - DNA, 20 bp, Artificial Sequence
  synthetic oligo
gagcgcgactctaatctcgg

SEQ ID NO: 1640 - DNA, 22 bp, Artificial Sequence
  synthetic oligo
cattgagcaagaagccaatgag

SEQ ID NO: 1641 - DNA, 42 bp, Artificial Sequence
  synthetic oligo
gcgtaatacgactcactatagggagcgcgactctaatctcgg

SEQ ID NO: 1642 - DNA, 811 bp, Nilaparvata lugens
ctgcgagtgcgcttgtccgacattgtctcgatccagccttgcccagacgtcaagtatggaaagcgtatccatgtgctgcccattgatgataccgttgagggtcttacaggaaatctgttcgaagtgtatttgaagccatacttcctggaagcatacaggccaattcacaaggatgatgcattcattgttcgcggaggtatgagagcggtcgaattcaaggtggttgaaacagatccatcgccctactgcattgtcgcgccagacaccgtcatccattgtgagggagaccccatcaaacgtgaggatgaagaagacgcagcaaacgcagtcggctacgacgacattggaggctgcagaaagcagctggcgcagatcaaagagatggtggagttgccgctgagacatcccagtctgttcaaggcgatcggcgtgaagccgccacgaggcatcctgctgtacggaccaccgggaaccggaaagacgttgatagcgcgcgccgtcgccaacgaaacgggcgccttcttcttcctcatcaacggacccgagattatgagcaaattggccggcgagtcggagagtaacctgcgcaaagctttcgaggaagcggacaaaaacgcaccggccatcatcttcatcgatgagctggacgcaatcgcgccaaaacgcgagaagacgcacggcgaggtggagcgacgcatcgtgtcgcagctgctgacgctgatggacggtctcaagcagagctcgcacgtgattgtcatggccgccaccaatcggcccaactcgatcgatgccgcgcttaggcgctttggcc

SEQ ID NO: 1643 - DNA, 41 bp, Artificial Sequence
  synthetic oligo
gcgtaatacgactcactataggctgcgagtgcgcttgtccg

SEQ ID NO: 1644 - DNA, 19 bp, Artificial Sequence
  synthetic oligo
ggccaaagcgcctaagcgc

SEQ ID NO: 1645 - DNA, 19 bp, Artificial Sequence
  synthetic oligo
ctgcgagtgcgcttgtccg

SEQ ID NO: 1646 - DNA, 41 bp, Artificial Sequence
  synthetic oligo
gcgtaatacgactcactataggggccaaagcgcctaagcgc

SEQ ID NO: 1647 - DNA, 688 bp, Nilaparvata lugens
gacgccagtatcagaagacatgcttggtcgtgtattcaacggaagtggtaagcccatcgacaaaggacctcccattcttgctgaggattatctcgacattcaaggtcaacccatcaatccttggtcgcgtatctatcccgaggaaatgatccagactggaatttcagccatcgacgtcatgaactcgattgctcgtggccagaaaatccccatcttttcagctgccggtctacctcacaacgaaattgctgctcaaatctgtagacaggctggtcttgtcaaactgccaggaaagtcagttctcgatgactctgaggacaactttgctattgtattcgcagccatgggagtcaacatggaaactgctcgattcttcaaacaggatttcgaggagaacggctctatggagaacgtgtgcctgttcttgaacctggcgaacgacccgacgatcgagcgtatcatcacaccacgcctggcgctgacggccgccgagttcctggcctaccagtgcgagaagcacgtgctcgtcatcctcaccgacatgagctcctacgccgaggcgctgcgagaggtgtccgccgcccgcgaggaggtgcccggccgtcgtggtttccccggttacatgtacaccgatctggccaccatctacgagcgcgccggacgagtcgagggtcgcaacggctccatc

SEQ ID NO: 1648 - DNA, 45 bp, Artificial Sequence
  synthetic oligo
gcgtaatacgactcactatagggacgccagtatcagaagacatgc

SEQ ID NO: 1649 - DNA, 18 bp, Artificial Sequence
  synthetic oligo
gatggagccgttgcgacc

SEQ ID NO: 1650 - DNA, 23 bp, Artificial Sequence
  synthetic oligo
gacgccagtatcagaagacatgc

SEQ ID NO: 1651 - DNA, 40 bp, Artificial Sequence
  synthetic oligo
gcgtaatacgactcactatagggatggagccgttgcgacc

SEQ ID NO: 1652 - DNA, 828 bp, Nilaparvata lugens
gcaaatgcctgtgccacgcccacaaatagaaagcacacaacagtttattcgatccgagaaaacaacatactcgaatggattcaccaccattgaggaggacttcaaagtagacactttcgaataccgtcttctgcgcgaggtgtcgttccgcgaatctctgatcagaaactacttgcacgaggcggacatgcagatgtcgacggtggtggaccgagcattgggtcccccctcggcgccacacatccagcagaagccgcgcaactcaaaaatccaggagggcggcgatgccgtcttttccatcaagctcagcgccaaccccaagcctcggctggtctggttcaagaacggtcagcgcatcggtcagacgcagaaacaccaggcctcctactccaatcagaccgccacgctcaaggtcaacaaagtcagcgctcaagactccggccactacacgctgcttgctgaaaatccgcaaggatgtactgtgtcctcagcttacctagctgtcgaatcagctggcactcaagatacaggatacagtgagcaatacagcagacaagaggtggagacgacagaggcggtggacagcagcaagatgctggcaccgaactttgttcgcgtgccggccgatcgcgacgcgagcgaaggcaagatgacgcggtttgactgccgcgtgacgggccgaccctacccggacgtggcctggttcatcaacggccaacaggtggctgacgacgccacgcacaagatcctcgtcaacgagtctggcaaccactcgctcatgatcaccggcgtcactcgcttggaccacggagtggtcggctgtattgc

SEQ ID NO: 1653 - DNA, 41 bp, Artificial Sequence
  synthetic oligo
gcgtaatacgactcactatagggcaaatgcctgtgccacgc

SEQ ID NO: 1654 - DNA, 21 bp, Artificial Sequence
  synthetic oligo
gcaatacagccgaccactccg

SEQ ID NO: 1655 - DNA, 19 bp, Artificial Sequence
  synthetic oligo
gcaaatgcctgtgccacgc

SEQ ID NO: 1656 - DNA, 43 bp, Artificial Sequence
  synthetic oligo
gcgtaatacgactcactatagggcaatacagccgaccactccg

SEQ ID NO: 1657 - DNA, 313 bp, Nilaparvata lugens
gcttcagatttgggacacggccggccaggagcggttccgcacgatcacatcgagctactaccggggcgcccacggcatcattgtggtgtacgactgcaccgaccaggagtcgttcaacaacctcaaacagtggctcgaggagattgaccgctacgcctgtgataatgtcaacaaactgctcgtcggcaacaagtgtgatcagaccaacaaaaaggtcgtcgactatacacaggctaaggaatacgccgaccagctgggcattccgttcctggagacgtcggcgaagaacgcgaccaatgtggagcaggcgttc

SEQ ID NO: 1658 - DNA, 43 bp, Artificial Sequence
  synthetic oligo
gcgtaatacgactcactatagggcttcagatttgggacacggc

SEQ ID NO: 1659 - DNA, 20 bp, Artificial Sequence
  synthetic oligo
gaacgcctgctccacattgg

SEQ ID NO: 1660 - DNA, 21 bp, Artificial Sequence
  synthetic oligo
gcttcagatttgggacacggc

SEQ ID NO: 1661 - DNA, 42 bp, Artificial Sequence
  synthetic oligo
gcgtaatacgactcactatagggaacgcctgctccacattgg

SEQ ID NO: 1662 - DNA, 443 bp, Nilaparvata lugens
cgtcagtctcaattctgtcaccgatatcagcaccacgttcattctcaagccacaagagaacgtgaagataacgcttgagggcgcacaggcctgtttcatttcacacgaacgacttgtgatctcactgaagggaggagaactctatgttctaactctctattccgatagtatgcgcagtgtgaggagttttcatctggagaaagctgctgccagtgtcttgactacttgtatctgtgtttgtgaggagaactatctgttccttggttcccgtcttggaaactcactgttgctcaggtttactgagaaggaattgaacctgattgagccgagggccatcgaaagctcacagtcccagaatccggccaagaagaaaaagctggatactttgggagattggatggcatctgacgtcactgaaatacgcgacctggatgaactagaag

SEQ ID NO: 1663 - DNA, 45 bp, Artificial Sequence
  synthetic oligo
gcgtaatacgactcactataggcgtcagtctcaattctgtcaccg

SEQ ID NO: 1664 - DNA, 22 bp, Artificial Sequence
  synthetic oligo
cttctagttcatccaggtcgcg

SEQ ID NO: 1665 - DNA, 23 bp, Artificial Sequence
  synthetic oligo
cgtcagtctcaattctgtcaccg

SEQ ID NO: 1666 - DNA, 44 bp, Artificial Sequence
  synthetic oligo
gcgtaatacgactcactataggcttctagttcatccaggtcgcg

SEQ ID NO: 1667 - DNA, 647 bp, Nilaparvata lugens
ctcacgagaggacgttgcacactgatatactgttcggtttggtgaaagatgtcgcccgattcagacctgacttgaagctgctcatatcaagcgccacactggatgctcagaaattctccgagtttttcgacgatgcacccatcttcaggattccgggccgtagatttccggtggacatctactacacaaaggcgcccgaggctgactacgtggacgcatgtgtcgtttcgatcctgcagatccacgccactcagccgctgggagacatcctggtcttcctcaccggtcaggaggagatcgaaacctgccaggagctgctgcaggacagagtgcgcaggcttgggtctcgtatcaaggagctgctcatattgcccgtctattccaacctacccagtgatatgcaggcaaagattttcctgcccactccaccaaatgctagaaaggtagtattggccacaaatattgcagaaacctcattgaccatcgacaatataatctacgtgattgatcctggtttttgtaagcagaataacttcaattcaaggactggaatggaatcgcttgttgtagtgcctgtttcaaaggcatcggccaatcagcgagcagggcgggcgggacgggtggcggccggcaagtgcttccgtctg

SEQ ID NO: 1668 - DNA, 44 bp, Artificial Sequence
  synthetic oligo
gcgtaatacgactcactataggctcacgagaggacgttgcacac

SEQ ID NO: 1669 - DNA, 19 bp, Artificial Sequence
  synthetic oligo
cagacggaagcacttgccg

SEQ ID NO: 1670 - DNA, 22 bp, Artificial Sequence
  synthetic oligo
ctcacgagaggacgttgcacac

SEQ ID NO: 1671 - DNA, 41 bp, Artificial Sequence
  synthetic oligo
gcgtaatacgactcactataggcagacggaagcacttgccg

SEQ ID NO: 1672 - DNA, 545 bp, Nilaparvata lugens
gtcctcggacgggaggtccacgtgtttaccgggattccgtttgcgaaacctcccatcggtccgttgcgattccgtaaaccggttcccgtcgacccgtggcacggcgttctggatgcgaccgcgcttcccaacagctgctaccaggaacggtacgagtatttcccgggcttcgagggagaggaaatgtggaatccgaatacgaatttgtccgaagattgtctgtatttgaacatatgggtgccgcaccggttgagaatccgacacagagccaacagcgaggagaataaaccaagagcgaaggtgccggtgctgatctggatctacggcgggggttacatgagcggcacagctacactggacgtgtacgatgctgacatggtggccgccacgagtgacgtcatcgtcgcctccatgcagtaccgagtgggtgcgttcggcttcctctacctcgcacaggacttgcctcgaggcagcgaggaggcgccgggcaacatggggctctgggaccaggcccttgccatccgctggctcaaggacaacattgc

SEQ ID NO: 1673 - DNA, 41 bp, Artificial Sequence
  synthetic oligo
gcgtaatacgactcactatagggtcctcggacgggaggtcc

SEQ ID NO: 1674 - DNA, 22 bp, Artificial Sequence
  synthetic oligo
gcaatgttgtccttgagccagc

SEQ ID NO: 1675 - DNA, 19 bp, Artificial Sequence
  synthetic oligo
gtcctcggacgggaggtcc

SEQ ID NO: 1676 - DNA, 44 bp, Artificial Sequence
  synthetic oligo
gcgtaatacgactcactatagggcaatgttgtccttgagccagc

SEQ ID NO: 1677 - DNA, 850 bp, Nilaparvata lugens; identical to SEQ ID NO: 1113

SEQ ID NO: 1678 - DNA, 40 bp, Artificial Sequence
  synthetic oligo
gcgtaatacgactcactataggagaagacggcacggtgcg

SEQ ID NO: 1679 - DNA, 25 bp, Artificial Sequence
  synthetic oligo
caatccagtttttacagtttcgtgc

SEQ ID NO: 1680 - DNA, 18 bp, Artificial Sequence
  synthetic oligo
agaagacggcacggtgcg

SEQ ID NO: 1681 - DNA, 47 bp, Artificial Sequence
  synthetic oligo
gcgtaatacgactcactataggcaatccagtttttacagtttcgtgc

SEQ ID NO: 1682 - DNA, 655 bp, Chilo suppressalis
taaagcatggatgttggacaaactgggtggcgtgtacgcgccgcggccgtcgaccggcccccacaagttgcgcgagtgcctgccgctggtgatcttcctcaggaaccggctcaagtacgcgctcaccggaaatgaagtgcttaagattgtaaagcagcgacttatcaaagttgacggcaaagtcaggacagaccccacatatcccgctggatttatggatgttgtttccattgaaaagacaaatgagctgttccgtcttatatatgatgtcaaaggcagatttactattcaccgtattactcctgaggaggctaaatacaagctgtgcaaggtgcggcgcgtggcgacgggccccaagaacgtgccttacctggtgacccacgacggacgcaccgtgcgataccccgacccactcatcaaggtcaacgactccatccagctcgacatcgccacctccaagatcatggacttcatcaagtttgaatctggtaacctatgtatgatcacgggaggccgtaacttggggcgcgtgggcaccatcgtgtcccgcgagcgacatcccgggtccttcgacatcgtgcatatacgggactccaccggacataccttcgctaccagattgaacaacgtgttcataatcggcaagggcacgaag

SEQ ID NO: 1683 - protein, 232 aa, Chilo suppressalis
KAWMLDKLGGVYAPRPSTGPHKLRECLPLVIFLRNRLKYALTGNEVLKIVKQRLIKVDGKVRTDPTYPAGFMDVVSIEKTNELFRLIYDVKGRFTIHRITPEEAKYKLCKVRRVATGPKNVPYLVTHDGRTVRYPDPLIKVNDSIQLDIATSKIMDFIKFESGNLCMITGGRNLGRVGTIVSRERHPGSFDIVHIRDSTGHTFATRLNNVFIIGKGTKAYISLPRGKGVRLT

SEQ ID NO: 1684 - DNA, 396 bp, Chilo suppressalis
gagtttctttagtaaagtattcggtggcaagaaggaggagaagggtccatcaacacacgaagctatacagaaattacgcgaaacggaagagttattgcagaagaaacaagagtttctagagcgaaagatcgacactgaattacaaacggcgagaaaacatggcacaaagaataagagagctgccattgcggcactgaagcgcaagaagcgttatgaaaagcagcttacccagattgatggcacgcttacccaaattgaggcccaaagggaagcgctagaaggagctaacaccaatacacaggtgcttaacactatgcgagatgctgctaccgctatgagactcgcccacaaggatatcgatgtagacaaggtacacgatctgatggatgacattgc

SEQ ID NO: 1685 - protein, 131 aa, Chilo suppressalis
SFFSKVFGGKKEEKGPSTHEAIQKLRETEELLQKKQEFLERKIDTELQTARKHGTKNKRAAIAALKRKKRYEKQLTQIDGTLTQIEAQREALEGANTNTQVLNTMRDAATAMRLAHKDIDVDKVHDLMDDI

SEQ ID NO: 1686 - DNA, 406 bp, Chilo suppressalis
tggtctccgcaacaagcgtgaggtgtggagggtgaagtacacgctggccaggatccgtaaggctgcccgtgagctgctcacactcgaggagaaagaccctaagaggttattcgaaggtaatgctctccttcgtcgtctggtgaggatcggtgtgttggatgagaagcagatgaagctcgattatgtactcggtctgaagattgaggacttcttggaacgtcgtctccagactcaggtgttcaaggctggtctagctaagtctatccatcatgcccgtattcttatcagacagaggcacatccgtgtccgcaagcaagttgtgaacatcccttcgttcatcgtgcggctggactctggcaagcacattgacttctcgctgaagtctccgttcggcggcggccggccg

SEQ ID NO: 1687 - protein, 135 aa, Chilo suppressalis
GLRNKREVWRVKYTLARIRKAARELLTLEEKDPKRLFEGNALLRRLVRIGVLDEKQMKLDYVLGLKIEDFLERRLQTQVFKAGLAKSIHHARILIRQRHIRVRKQVVNIPSFIVRLDSGKHIDFSLKSPFGGGRP

SEQ ID NO: 1688 - DNA, 530 bp, Chilo suppressalis
acctgccaaggaatgaggaacgctttgtatgacaaattggatgatgatggtataattgcaccagggattcgtgtatctggtgacgatgtagtcattggaaaaactataactttgccagaaaacgatgatgagctggaaggaacatcaagacgatacagtaagagagatgcctctacattcttgcgaaacagtgaaactggtattgttgaccaagttatgcttacacttaacagcgaaggatacaaattttgtaaaatacgtgtgagatctgtgagaatcccacaaattggagacaaatttgcttctcgtcatggtcaaaaagggacttgtggtattcaatataggcaagaagatatgcctttcacttgtgaaggattgacaccagatattatcatcaatccacatgctatcccctctcgtatgacaattggtcacttgattgaatgtattcaaggtaaggtctcctcaaataaaggtgaaataggtgatgctacaccatttaacgatgctgtcaacgtgcagaagatctc

SEQ ID NO: 1689 - protein, 176 aa, Chilo suppressalis
TCQGMRNALYDKLDDDGIIAPGIRVSGDDVVIGKTITLPENDDELEGTSRRYSKRDASTFLRNSETGIVDQVMLTLNSEGYKFCKIRVRSVRIPQIGDKFASRHGQKGTCGIQYRQEDMPFTCEGLTPDIIINPHAIPSRMTIGHLIECIQGKVSSNKGEIGDATPFNDAVNVQKI

SEQ ID NO: 1690 - DNA, 959 bp, Chilo suppressalis
tttcagagatttcttgttggaaccagagattttgggggctatcgtcgattgcggtttcgagcacccttcagaagttcaacatgaatgtattccccaagctgttttgggaatggatattctttgtcaaagctaaatccggaatgggaaaaaccgccgtatttgttttagcaacactgcaacagctagaaccttcagaaaaccatgtttacgtattagtaatgtgccatacaagggaactcgctttccaaataagcaaggaatatgagaggttctctaaatatatggctggtgttagagtatctgtattctttggtgggatgccaattcagaaagatgaagaagtattgaagacagcctgcccgcacatcgttgttggtactcctggcagaatattagcattggttaacaacaagaaactgaatttaaaacacctgaaacacttcatcctggatgaatgtgacaaaatgcttgaatctctagacatgagacgtgatgtgcaggaaatattcaggaacacccctcacggtaagcaggtcatgatgttttctgcaacattgagtaaggagatcagaccagtctgtaagaaatttatgcaagatcctatggaagtttatgtggatgatgaagctaaacttacattgcacggtttgcagcaacattatgttaaactcaaggaaaatgaaaagaataagaagttatttgaacttttggatgtactggagttcaaccaagttgtcatatttgtaaagtcagtgcagcgctgcatagctctcgcacagctgctgacagaccaaaacttcccagctattggtatacaccgaaatatgactcaagatgagcgtctctcccgctatcagcagttcaaagatttccagaagaggatccttgttgcgacaaatctttttggacggggtatggacattgaaagagtcaacatagtcttcaattatgacatgccg

SEQ ID NO: 1691 - protein, 319 aa, Chilo suppressalis
SEISCWNQRFWGLSSIAVSSTLQKFNMNVFPKLFWEWIFFVKAKSGMGKTAVFVLATLQQLEPSENHVYVLVMCHTRELAFQISKEYERFSKYMAGVRVSVFFGGMPIQKDEEVLKTACPHIVVGTPGRILALVNNKKLNLKHLKHFILDECDKMLESLDMRRDVQEIFRNTPHGKQVMMFSATLSKEIRPVCKKFMQDPMEVYVDDEAKLTLHGLQQHYVKLKENEKNKKLFELLDVLEFNQVVIFVKSVQRCIALAQLLTDQNFPAIGIHRNMTQDERLSRYQQFKDFQKRILVATNLFGRGMDIERVNIVFNYDMP

SEQ ID NO: 1692 - DNA, 542 bp, Chilo suppressalis
cctcgttgccatttgtatttggacgtttctgcagcggctggactcacgggagcccatgtggcagctggacgagagcatcatcggcaccaaccccgggctcggcttccggcccacgccgccagaggtcgccagcagcgtcatctggtataaaggcaacgaccccaacagccaacaattctgggtgcaagaaacctccaactttctaaccgcgtacaaacgagacggtaagaaagcaggagcaggccagaacatccacaactgtgatttcaaactgcctcctccggccggtaaggtgtgcgacgtggacatcagcgcctggagtccctgtgtagaggacaagcactttggataccacaagtccacgccctgcatcttcctcaaactcaacaagatcttcggctggaggccgcacttctacaacagctccgacagcctgcccactgacatgcccgacgacttgaaggagcacatcaggaatatgacagcgtacgataagaattatctaaacatggtatgggtgtcttgcgagggagagaatccag

SEQ ID NO: 1693 - protein, 180 aa, Chilo suppressalis
LVAICIWTFLQRLDSREPMWQLDESIIGTNPGLGFRPTPPEVASSVIWYKGNDPNSQQFWVQETSNFLTAYKRDGKKAGAGQNIHNCDFKLPPPAGKVCDVDISAWSPCVEDKHFGYHKSTPCIFLKLNKIFGWRPHFYNSSDSLPTDMPDDLKEHIRNMTAYDKNYLNMVWVSCEGENP

SEQ ID NO: 1694 - DNA, 495 bp, Chilo suppressalis
ggctccggcaagacgacctttgtcaaacgacacttgactggagagttcgagaaaagatatgtcgccacattaggtgtcgaggtgcatcccttagtattccacacaaatagaggccctataaggtttaatgtatgggatactgctggccaagaaaagtttggtggtctccgagatggttactatatccaaggtcaatgtgccatcatcatgttcgatgtaacgtctcgtgtcacctacaaaaatgtacccaactggcacagagatttagtgcgagtctgtgaaggcattccaattgttctttgtggcaacaaagtagatatcaaggacagaaaagtcaaagcaaaaactattgttttccacagaaaaaagaaccttcagtattatgacatctctgccaagtcaaactacaatttcgagaaacccttcctctggttagcgagaaagttgatcggtgatggtaacctagagtttgtcgccatgcagccctgcttccac

SEQ ID NO: 1695 - protein, 165 aa, Chilo suppressalis
GSGKTTFVKRHLTGEFEKRYVATLGVEVHPLVFHTNRGPIRFNVWDTAGQEKFGGLRDGYYIQGQCAIIMFDVTSRVTYKNVPNWHRDLVRVCEGIPIVLCGNKVDIKDRKVKAKTIVFHRKKNLQYYDISAKSNYNFEKPFLWLARKLIGDGNLEFVAMQPCFH

SEQ ID NO: 1696 - DNA, 401 bp, Chilo suppressalis
cagatgcgcccgttgttgatactgccgaacaggtatacatctcgtctttggccctgttgaagatgttaaaacacgggcgcgccggtgttccaatggaagttatgggacttatgttaggtgaatttgttgatgattacacggtgcgtgtcatagacgtatttgccatgcctcaaactggcacaggagtgtcggttgaagctgtagatcctgtcttccaagcaaagatgttggatatgttgaagcaaactggacgacctgagatggtagtgggatggtaccactcgcatcctggctttggatgttggttatctggagtcgacattaatactcagcagtctttcgaagctttgtctgaacgtgctgtagctgtagtggttgatcccattcagtctgtcaagggc

SEQ ID NO: 1697 - protein, 133 aa, Chilo suppressalis
DAPVVDTAEQVYISSLALLKMLKHGRAGVPMEVMGLMLGEFVDDYTVRVIDVFAMPQTGTGVSVEAVDPVFQAKMLDMLKQTGRPEMVVGWYHSHPGFGCWLSGVDINTQQSFEALSERAVAVVVDPIQSVKG

SEQ ID NO: 1698 - DNA, 626 bp, Chilo suppressalis
ttcaaaagcagatcaagcatatgatggccttcatcgaacaagaggctaatgaaaaggccgaggaaatcgatgcaaaggccgaagaggagttcaacattgaaaaaggccgcctggtgcagcagcagcggctcaagatcatggaatactacgaaaagaaagagaaacaagtggaactccagaaaaagatccaatcttcgaacatgctgaatcaagcccgtctgaaggtgctcaaagtgcgtgaggaccacgtacgcaacgttctcgacgaggctcgcaagcgcctggctgaggtgcccaaagacgtgaaactttacacagatctgctggtcacgctcgtcgtacaagccctattccagctcatggaacccacagtaacagttcgcgttaggcaggcggacgtctccttagtacagtccatattgggcaaggcacagcaggattacaaagcaaagatcaagaaggacgttcaattgaagatcgacaccgagaattccctgcccgccgatacttgtggcggagtggaacttattgctgctagagggcgtattaagatcagcaacactctggagtctcgtctggagctgatagcccaacaactgttgcccgaaatacgtaccgcattgttc

SEQ ID NO: 1699 - protein, 208 aa, Chilo suppressalis
QKQIKHMMAFIEQEANEKAEEIDAKAEEEFNIEKGRLVQQQRLKIMEYYEKKEKQVELQKKIQSSNMLNQARLKVLKVREDHVRNVLDEARKRLAEVPKDVKLYTDLLVTLVVQALFQLMEPTVTVRVRQADVSLVQSILGKAQQDYKAKIKKDVQLKIDTENSLPADTCGGVELIAARGRIKISNTLESRLELIAQQLLPEIRTALF

SEQ ID NO: 1700 - DNA, 864 bp, Chilo suppressalis
atcgtgctttcagacgataactgccccgatgagaagatccgcatgaaccgcgtcgtgcgaaacaacttgcgtgtacgcctgtcagacatagtctccatagcgccttgtccatcggtcaaatatgggaaacgggtacatatattgcccattgatgattctgtcgagggtttgactggaaatttattcgaagtctacttgaaaccatacttcatggaagcttatcggcctatccatcgcgatgacacattcatggttcgcgggggcatgagggctgttgaattcaaagtggtggagactgatccgtcgccgtattgcatcgtcgctcccgacacagtgatacactgcgaaggagaccctatcaaacgagaggaagaagaagaagccctaaacgccgtagggtacgacgacatcggtggctgtcgtaaacagctcgctcagatcaaagagatggtcgagttgcctctaaggcatccgtcgctgttcaaggcaattggtgtgaagccgccacgtggaatcctcatgtatgggccgcctggtaccggcaaaactctcattgctcgggcagtggctaatgaaactggtgcattcttctttctgatcaacgggccggagatcatgtccaaactcgcgggcgagtccgaatcgaaccttcgcaaggcattcgaggaagcggacaagaactccccggctataatcttcatcgatgaactggatgccatcgcaccaaagagggagaagactcacggtgaagtggagcgtcgtattgtgtcgcaactacttactcttatggatggaatgaagaagtcatcgcacgtgatcgtaatggccgccaccaaccgtccgaattcgatcgacccggcgcta

SEQ ID NO: 1701 - protein, 288 aa, Chilo suppressalis
IVLSDDNCPDEKIRMNRVVRNNLRVRLSDIVSIAPCPSVKYGKRVHILPIDDSVEGLTGNLFEVYLKPYFMEAYRPIHRDDTFMVRGGMRAVEFKVVETDPSPYCIVAPDTVIHCEGDPIKREEEEEALNAVGYDDIGGCRKQLAQIKEMVELPLRHPSLFKAIGVKPPRGILMYGPPGTGKTLIARAVANETGAFFFLINGPEIMSKLAGESESNLRKAFEEADKNSPAIIFIDELDAIAPKREKTHGEVERRIVSQLLTLMDGMKKSSHVIVMAATNRPNSIDPAL

SEQ ID NO: 1702 - DNA, 1144 bp, Chilo suppressalis
aggatggaagcggggatacgtttgagcatctccttggggaagatacggagcagctgccagccgatgtccagcgactcgaatactgtgcggttctcgtagttgccctgtgtgatgaagttcttctcgaacttggtgaggaactcgaggtagagcagatcgtcgggtgtcagggcttcctcaccgacgacagccttcatggcctgcacgtccttaccgatggcgtagcaggcgtacagctggttggaaacatcagagtggtccttgcgggtcattccctcaccgatggcagacttcatgagacgagacagggaaggcagcacgtttacaggcgggtagatctgtctgttgtggagctgacggtctacgtagatctgtccctcagtgatgtagcccgttaaatcgggaataggatgggtgatgtcgtcgttgggcatagtcaagatggggatctgcgtgatggatccgtttctaccctctacacgcccggctctctcgtagatggtggccaaatcggtgtacatgtaacctgggaaaccacgtcgtccgggcacctcctcacgggcggcggacacttcacgcagagcctccgcgtacgaagacatgtcagtcaagattaccagcacgtgtttctcacactggtaggccaagaactcagcagcagtcaaggccaaacgtggtgtgatgattctctcaatagtgggatcgttggccagattcaagaacaggcacacgttctccatggagccgttctcctcgaagtcctgcttgaagaaccgggccgtctccatgttcacacccatggcggcgaacacgatggcaaagttgtcctcgtggtcgtccagcacagatttgccggggatctttacaagaccggcttgcctacagatctgggcggcaatttcgttgtgtggcagaccggcagccgagaaaatggggatcttttgcccgcgagcaatggagttcatcacgtcgatagcggagataccagtctggatcatttcctcagggtagatacgggaccaggggttgatgggctgtccctggatgtccaaaaagtcttcagcaaggattgggggacctttgtcaatgggttttccagagccgttgaatacgcgacccaacatgtcttcggagacaggggtgc

SEQ ID NO: 1703 - protein, 380 aa, Chilo suppressalis
TPVSEDMLGRVFNGSGKPIDKGPPILAEDFLDIQGQPINPWSRIYPEEMIQTGISAIDVMNSIARGQKIPIFSAAGLPHNEIAAQICRQAGLVKIPGKSVLDDHEDNFAIVFAAMGVNMETARFFKQDFEENGSMENVCLFLNLANDPTIERIITPRLALTAAEFLAYQCEKHVLVILTDMSSYAEALREVSAAREEVPGRRGFPGYMYTDLATIYERAGRVEGRNGSITQIPILTMPNDDITHPIPDLTGYITEGQIYVDRQLHNRQIYPPVNVLPSLSRLMKSAIGEGMTRKDHSDVSNQLYACYAIGKDVQAMKAVVGEEALTPDDLLYLEFLTKFEKNFITQGNYENRTVFESLDIGWQLLRIFPKEMLKRIPASI

SEQ ID NO: 1704 - DNA, 1225 bp, Chilo suppressalis
gctccgtctacattcagccggaaggcgtccctgtacctgctcagcaatcccaacagcagcagagttaccgccacgtcagcgagagcgtcgaacacaaatcctacggcacgcaagggtacaccacttcggaacagaccaagcagacacagaaggtggcgtacaccaacggttccgactactcttccacggacgactttaaggtggatacgttcgaatacagactcctccgagaagtttcgttcagggaatccatcacgaagcggtacattggcgagacagacattcagatcagcacggaggtcgacaagtctctcggtgtggtgacccctcctaagatagcacaaaagcctaggaattccaagctgcaggagggagccgacgctcagtttcaagtgcagctgtcgggtaacccgcggccacgggtgtcatggttcaagaacgggcagaggatagtcaactcgaacaaacacgaaatcgtcacgacacataatcaaacaatacttagggtaagaaacacacaaaagtctgatactggcaactacacgttgttggctgaaaatcctaacggatgcgtcgtcacatcggcatacctggccgtggagtcgcctcaagaaacttacggccaagatcataaatcacaatacataatggacaatcagcaaacagctgtagaagaaagagtagaagttaatgaaaaagctctcgctccgcaattcgtaagagtctgccaagaccgcgatgtaacggaggggaaaatgacgcgattcgattgccgcgtcacgggcagaccttacccagaagtcacgtggttcattaacgatagacaaattcgagacgattatwatcataagatattagtaaacgaatcgtgtaatcatgcacttatgattacaaacgtcgatctcagtgatagtggcgtagtatcatgtatagcacgcaacaagaccggcgaaacttcgtttcagtgtaggctgaacgtgatagagaaggagcaagtggtcgctcccaaattcgtggagcggttcagcacgctcaacgtgcgcgagggcgagcccgtgcagctgcacgcgcgcgccgtcggcacgcctacgccacgcatcacatggcagaaggacggcgttcaagttatacccaatccagagctacgaataaataccgaaggtggggcctcgacgctggacatccctcgagccaaggcgtcggacgcgggatggtaccgatgcac

SEQ ID NO: 1705 - protein, 407 aa, Chilo suppressalis
  misc_feature (281)..(281): Xaa can be any naturally occurring amino acid
SVYIQPEGVPVPAQQSQQQQSYRHVSESVEHKSYGTQGYTTSEQTKQTQKVAYTNGSDYSSTDDFKVDTFEYRLLREVSFRESITKRYIGETDIQISTEVDKSLGVVTPPKIAQKPRNSKLQEGADAQFQVQLSGNPRPRVSWFKNGQRIVNSNKHEIVTTHNQTILRVRNTQKSDTGNYTLLAENPNGCVVTSAYLAVESPQETYGQDHKSQYIMDNQQTAVEERVEVNEKALAPQFVRVCQDRDVTEGKMTRFDCRVTGRPYPEVTWFINDRQIRDDYXHKILVNESCNHALMITNVDLSDSGVVSCIARNKTGETSFQCRLNVIEKEQVVAPKFVERFSTLNVREGEPVQLHARAVGTPTPRITWQKDGVQVIPNPELRINTEGGASTLDIPRAKASDAGWYRC

SEQ ID NO: 1706 - DNA, 23 bp, Artificial Sequence
  synthetic oligo
catttgaagcgtttwrmygcycc

SEQ ID NO: 1707 - DNA, 28 bp, Artificial Sequence
  synthetic oligo
cttcgtgcccttgccratkatraabacg

SEQ ID NO: 1708 - DNA, 27 bp, Artificial Sequence
  synthetic oligo
gagtttctttagtaaagtattcggtgg

SEQ ID NO: 1709 - DNA, 26 bp, Artificial Sequence
  synthetic oligo
gcaatgtcatccatcakrtcrtgtac

SEQ ID NO: 1710 - DNA, 26 bp, Artificial Sequence
  synthetic oligo
caggagttgarrathatygghsarta

SEQ ID NO: 1711 - DNA, 24 bp, Artificial Sequence
  synthetic oligo
caggttcttcctcttkacrcgdcc

SEQ ID NO: 1712 - DNA, 23 bp, Artificial Sequence
  synthetic oligo
acctgccaaggaatgmgvaaygc

SEQ ID NO: 1713 - DNA, 26 bp, Artificial Sequence
  synthetic oligo
gagatcttctgcacrttkacvgcatc

SEQ ID NO: 1714 - DNA, 22 bp, Artificial Sequence
  synthetic oligo
cggtgtccattcacagytccgg

SEQ ID NO: 1715 - DNA, 26 bp, Artificial Sequence
  synthetic oligo
cgatgcaagtaggtgtckgartcytc

SEQ ID NO: 1716 - DNA, 22 bp, Artificial Sequence
  synthetic oligo
cctcgttgccatytgywtktgg

SEQ ID NO: 1717 - DNA, 26 bp, Artificial Sequence
  synthetic oligo
ctggattctctccctcgcamgahacc

SEQ ID NO: 1718 - DNA, 24 bp, Artificial Sequence
  synthetic oligo
ggctccggcaagacvacmttygtc

SEQ ID NO: 1719 - DNA, 25 bp, Artificial Sequence
  synthetic oligo
gtggaagcagggcwggcatkgcrac

SEQ ID NO: 1720 - DNA, 24 bp, Artificial Sequence
  synthetic oligo
ggatcgtctgctamgwytwggagg

SEQ ID NO: 1721 - DNA, 21 bp, Artificial Sequence
  synthetic oligo
ctatggtgtccagcatsgcgc

SEQ ID NO: 1722 - DNA, 22 bp, Artificial Sequence
  synthetic oligo
atggcactgagcgaygchgatg

SEQ ID NO: 1723 - DNA, 24 bp, Artificial Sequence
  synthetic oligo
gaacttgcggttgabgttscgdcc

SEQ ID NO: 1724 - DNA, 20 bp, Artificial Sequence
  synthetic oligo
gccgcaaggagacbgtvtgc

SEQ ID NO: 1725 - DNA, 23 bp, Artificial Sequence
  synthetic oligo
cgatcaaagcgwccraavcgacg

SEQ ID NO: 1726 - DNA, 21 bp, Artificial Sequence
  synthetic oligo
gttcaccggcgayatyctgcg

SEQ ID NO: 1727 - DNA, 21 bp, Artificial Sequence
  synthetic oligo
gtcgcgcaggtagaaytckgc

SEQ ID NO: 1728 - DNA, 25 bp, Artificial Sequence
  synthetic oligo
  misc_feature (20)..(20): n is a, c, g, or t
gctccgtctacathcarccngargg

SEQ ID NO: 1729 - DNA, 23 bp, Artificial Sequence
  synthetic oligo
gtgcatcggtaccahschgcrtc

SEQ ID NO: 1730 - DNA, 21 bp, Chilo suppressalis
aaagcatggatgttggacaaa

SEQ ID NO: 1731 - DNA, 23 bp, Chilo suppressalis
aaagcatggatgttggacaaact

SEQ ID NO: 1732 - DNA, 23 bp, Chilo suppressalis
aaccggctcaagtacgcgctcac

SEQ ID NO: 1733 - DNA, 26 bp, Chilo suppressalis
aaccggctcaagtacgcgctcaccgg

SEQ ID NO: 1734 - DNA, 23 bp, Chilo suppressalis
aagatcatggacttcatcaagtt

SEQ ID NO: 1735 - DNA, 23 bp, Chilo suppressalis
accagattgaacaacgtgttcat

SEQ ID NO: 1736 - DNA, 26 bp, Chilo suppressalis
atcatggacttcatcaagtttgaatc

SEQ ID NO: 1737 - DNA, 24 bp, Chilo suppressalis
caagatcatggacttcatcaagtt

SEQ ID NO: 1738 - DNA, 21 bp, Chilo suppressalis
ccccacaagttgcgcgagtgc

SEQ ID NO: 1739 - DNA, 23 bp, Chilo suppressalis
cccgctggatttatggatgttgt

SEQ ID NO: 1740 - DNA, 28 bp, Chilo suppressalis
cctccaagatcatggacttcatcaagtt

SEQ ID NO: 1741 - DNA, 21 bp, Chilo suppressalis
cctgccgctggtgatcttcct

SEQ ID NO: 1742 - DNA, 22 bp, Chilo suppressalis
cgacgggccccaagaacgtgcc

SEQ ID NO: 1743 - DNA, 21 bp, Chilo suppressalis
ctcatcaaggtcaacgactcc

SEQ ID NO: 1744 - DNA, 35 bp, Chilo suppressalis
ctcatcaaggtcaacgactccatccagctcgacat

SEQ ID NO: 1745 - DNA, 43 bp, Chilo suppressalis
ctcatcaaggtcaacgactccatccagctcgacatcgccacct

SEQ ID NO: 1746 - DNA, 21 bp, Chilo suppressalis
ctgccgctggtgatcttcctc

SEQ ID NO: 1747 - DNA, 23 bp, Chilo suppressalis
gaccccacatatcccgctggatt

SEQ ID NO: 1748 - DNA, 21 bp, Chilo suppressalis
gcagcgacttatcaaagttga

SEQ ID NO: 1749 - DNA, 23 bp, Chilo suppressalis
gcatggatgttggacaaactggg

SEQ ID NO: 1750 - DNA, 26 bp, Chilo suppressalis
gccacctccaagatcatggacttcat

SEQ ID NO: 1751 - DNA, 30 bp, Chilo suppressalis
gcgcgtggcgacgggccccaagaacgtgcc

SEQ ID NO: 1752 - DNA, 22 bp, Chilo suppressalis
gctggatttatggatgttgttt

SEQ ID NO: 1753 - DNA, 22 bp, Chilo suppressalis
ggctcaagtacgcgctcaccgg

SEQ ID NO: 1754 - DNA, 24 bp, Chilo suppressalis
gtgggcaccatcgtgtcccgcgag

SEQ ID NO: 1755 - DNA, 26 bp, Chilo suppressalis
gtgggcaccatcgtgtcccgcgagcg

SEQ ID NO: 1756 - DNA, 35 bp, Chilo suppressalis
gtgggcaccatcgtgtcccgcgagcgacatcccgg

SEQ ID NO: 1757 - DNA, 21 bp, Chilo suppressalis
taaagcatggatgttggacaa

SEQ ID NO: 1758 - DNA, 22 bp, Chilo suppressalis
taaagcatggatgttggacaaa

SEQ ID NO: 1759 - DNA, 24 bp, Chilo suppressalis
taaagcatggatgttggacaaact

SEQ ID NO: 1760 - DNA, 27 bp, Chilo suppressalis
taaagcatggatgttggacaaactggg

SEQ ID NO: 1761 - DNA, 38 bp, Chilo suppressalis
tacaagctgtgcaaggtgcggcgcgtggcgacgggccc

SEQ ID NO: 1762 - DNA, 41 bp, Chilo suppressalis
tacaagctgtgcaaggtgcggcgcgtggcgacgggccccaa

SEQ ID NO: 1763 - DNA, 23 bp, Chilo suppressalis
taccccgacccactcatcaaggt

SEQ ID NO: 1764 - DNA, 22 bp, Chilo suppressalis
tgaacaacgtgttcataatcgg

SEQ ID NO: 1765 - DNA, 22 bp, Chilo suppressalis
tgcgcgagtgcctgccgctggt

SEQ ID NO: 1766 - DNA, 29 bp, Chilo suppressalis
tgtatgatcacgggaggccgtaacttggg

SEQ ID NO: 1767 - DNA, 32 bp, Chilo suppressalis
tgtatgatcacgggaggccgtaacttggggcg

SEQ ID NO: 1768 - DNA, 57 bp, Chilo suppressalis
tgtatgatcacgggaggccgtaacttggggcgcgtgggcaccatcgtgtcccgcgag

SEQ ID NO: 1769 - DNA, 35 bp, Chilo suppressalis
tgtgcaaggtgcggcgcgtggcgacgggccccaag

SEQ ID NO: 1770 - DNA, 35 bp, Chilo suppressalis
ttgaacaacgtgttcataatcggcaagggcacgaa

SEQ ID NO: 1771 - DNA, 29 bp, Chilo suppressalis
attgaggcccaaagggaagcgctagaagg

SEQ ID NO: 1772 - DNA, 22 bp, Chilo suppressalis
cacgatctgatggatgacattg

SEQ ID NO: 1773 - DNA, 27 bp, Chilo suppressalis
gagtttctttagtaaagtattcggtgg

SEQ ID NO: 1774 - DNA, 23 bp, Chilo suppressalis
tatgaaaagcagcttacccagat

SEQ ID NO: 1775 - DNA, 23 bp, Chilo suppressalis
aggcacatccgtgtccgcaagca

SEQ ID NO: 1776 - DNA, 21 bp, Chilo suppressalis
aagattgaggacttcttggaa

SEQ ID NO: 1777 - DNA, 23 bp, Chilo suppressalis
aagcacattgacttctcgctgaa

SEQ ID NO: 1778 - DNA, 23 bp, Chilo suppressalis
atcagacagaggcacatccgtgt

SEQ ID NO: 1779 - DNA, 21 bp, Chilo suppressalis
atccgtaaggctgcccgtgag

SEQ ID NO: 1780 - DNA, 24 bp, Chilo suppressalis
atccgtaaggctgcccgtgagctg

SEQ ID NO: 1781 - DNA, 26 bp, Chilo suppressalis
atccgtaaggctgcccgtgagctgct

SEQ ID NO: 1782 - DNA, 29 bp, Chilo suppressalis
atccgtaaggctgcccgtgagctgctcac

SEQ ID NO: 1783 - DNA, 22 bp, Chilo suppressalis
cacatccgtgtccgcaagcaag

SEQ ID NO: 1784 - DNA, 23 bp, Chilo suppressalis
cacatccgtgtccgcaagcaagt

SEQ ID NO: 1785 - DNA, 25 bp, Chilo suppressalis
cacatccgtgtccgcaagcaagttg

SEQ ID NO: 1786 - DNA, 21 bp, Chilo suppressalis
cgcaacaagcgtgaggtgtgg

SEQ ID NO: 1787 - DNA, 29 bp, Chilo suppressalis
cgtgtccgcaagcaagttgtgaacatccc

SEQ ID NO: 1788 - DNA, 30 bp, Chilo suppressalis
ctcgctgaagtctccgttcggcggcggccg

SEQ ID NO: 1789 - DNA, 23 bp, Chilo suppressalis
ctcggtctgaagattgaggactt

SEQ ID NO: 1790 - DNA, 29 bp, Chilo suppressalis
ctggactctggcaagcacattgacttctc

SEQ ID NO: 1791 - DNA, 32 bp, Chilo suppressalis
gacttctcgctgaagtctccgttcggcggcgg

SEQ ID NO: 1792 - DNA, 35 bp, Chilo suppressalis
gacttctcgctgaagtctccgttcggcggcggccg

SEQ ID NO: 1793 - DNA, 35 bp, Chilo suppressalis
gaggagaaagaccctaagaggttattcgaaggtaa

SEQ ID NO: 1794 - DNA, 21 bp, Chilo suppressalis
gatccgtaaggctgcccgtga

SEQ ID NO: 1795 - DNA, 27 bp, Chilo suppressalis
gatccgtaaggctgcccgtgagctgct

SEQ ID NO: 1796 - DNA, 32 bp, Chilo suppressalis
gattatgtactcggtctgaagattgaggactt

SEQ ID NO: 1797 - DNA, 26 bp, Chilo suppressalis
ggtctgaagattgaggacttcttgga

SEQ ID NO: 1798 - DNA, 23 bp, Chilo suppressalis
gtgtggagggtgaagtacacgct

SEQ ID NO: 1799 - DNA, 26 bp, Chilo suppressalis
gtgttcaaggctggtctagctaagtc

SEQ ID NO: 1800 - DNA, 35 bp, Chilo suppressalis
gtgttggatgagaagcagatgaagctcgattatgt

SEQ ID NO: 1801 - DNA, 22 bp, Chilo suppressalis
tgaagattgaggacttcttgga

SEQ ID NO: 1802 - DNA, 28 bp, Chilo suppressalis
tggactctggcaagcacattgacttctc

SEQ ID NO: 1803 - DNA, 22 bp, Chilo suppressalis
tggatgagaagcagatgaagct

SEQ ID NO: 1804 - DNA, 24 bp, Chilo suppressalis
tggtctccgcaacaagcgtgaggt

SEQ ID NO: 1805 - DNA, 28 bp, Chilo suppressalis
tggtctccgcaacaagcgtgaggtgtgg

SEQ ID NO: 1806 - DNA, 26 bp, Chilo suppressalis
cgtatgacaattggtcacttgattga

SEQ ID NO: 1807 - DNA, 26 bp, Chilo suppressalis
gaagatatgcctttcacttgtgaagg

SEQ ID NO: 1808 - DNA, 26 bp, Chilo suppressalis
ggaaaaactataactttgccagaaaa

SEQ ID NO: 1809 - DNA, 29 bp, Chilo suppressalis
ggtgatgctacaccatttaacgatgctgt

SEQ ID NO: 1810 - DNA, 26 bp, Chilo suppressalis
tctcgtatgacaattggtcacttgat

SEQ ID NO: 1811 - DNA, 22 bp, Chilo suppressalis
ctgtcaacgtgcagaagatctc

SEQ ID NO: 1812 - DNA, 26 bp, Chilo suppressalis
tggatgaatgtgacaaaatgcttgaa

SEQ ID NO: 1813 - DNA, 23 bp, Chilo suppressalis
tttatgcaagatcctatggaagt

SEQ ID NO: 1814 - DNA, 32 bp, Chilo suppressalis
aaatttatgcaagatcctatggaagtttatgt

SEQ ID NO: 1815 - DNA, 23 bp, Chilo suppressalis
aatatgactcaagatgagcgtct

SEQ ID NO: 1816 - DNA, 26 bp, Chilo suppressalis
atgactcaagatgagcgtctctcccg

SEQ ID NO: 1817 - DNA, 23 bp, Chilo suppressalis
atgcaagatcctatggaagttta

SEQ ID NO: 1818 - DNA, 26 bp, Chilo suppressalis
atgcaagatcctatggaagtttatgt

SEQ ID NO: 1819 - DNA, 30 bp, Chilo suppressalis
cgctatcagcagttcaaagatttccagaag

SEQ ID NO: 1820 - DNA, 21 bp, Chilo suppressalis
gaaaatgaaaagaataagaag

SEQ ID NO: 1821 - DNA, 23 bp, Chilo suppressalis
gaagttcaacatgaatgtattcc

SEQ ID NO: 1822 - DNA, 23 bp, Chilo suppressalis
gatgagcgtctctcccgctatca

SEQ ID NO: 1823 - DNA, 25 bp, Chilo suppressalis
tgccaattcagaaagatgaagaagt

SEQ ID NO: 1824 - DNA, 22 bp, Chilo suppressalis
tgtaagaaatttatgcaagatc

SEQ ID NO: 1825 - DNA, 21 bp, Chilo suppressalis
aggtgtgcgacgtggacatca

SEQ ID NO: 1826 - DNA, 23 bp, Chilo suppressalis
gacttgaaggagcacatcaggaa

SEQ ID NO: 1827 - DNA, 23 bp, Chilo suppressalis
ggccagaacatccacaactgtga

SEQ ID NO: 1828 - DNA, 21 bp, Chilo suppressalis
tcttgcgagggagagaatcca

SEQ ID NO: 1829 - DNA, 29 bp, Chilo suppressalis
aaaactattgttttccacagaaaaaagaa

SEQ ID NO: 1830 - DNA, 23 bp, Chilo suppressalis
atcaaggacagaaaagtcaaagc

SEQ ID NO: 1831 - DNA, 23 bp, Chilo suppressalis
atctctgccaagtcaaactacaa

SEQ ID NO: 1832 - DNA, 23 bp, Chilo suppressalis
caatgtgccatcatcatgttcga

SEQ ID NO: 1833 - DNA, 26 bp, Chilo suppressalis
cccaactggcacagagatttagtgcg

SEQ ID NO: 1834 - DNA, 31 bp, Chilo suppressalis
gacacttgactggagagttcgagaaaagata

SEQ ID NO: 1835 - DNA, 23 bp, Chilo suppressalis
gatatcaaggacagaaaagtcaa

SEQ ID NO: 1836 - DNA, 23 bp, Chilo suppressalis
gccaagtcaaactacaatttcga

SEQ ID NO: 1837 - DNA, 24 bp, Chilo suppressalis
gctggccaagaaaagtttggtggt

SEQ ID NO: 1838 - DNA, 26 bp, Chilo suppressalis
ggccaagaaaagtttggtggtctccg

SEQ ID NO: 1839 - DNA, 23 bp, Chilo suppressalis
tacaaaaatgtacccaactggca

SEQ ID NO: 1840 - DNA, 29 bp, Chilo suppressalis
tacaaaaatgtacccaactggcacagaga

SEQ ID NO: 1841 - DNA, 23 bp, Chilo suppressalis
tatgggatactgctggccaagaa

SEQ ID NO: 1842 - DNA, 24 bp, Chilo suppressalis
tatgggatactgctggccaagaaa

SEQ ID NO: 1843 - DNA, 21 bp, Chilo suppressalis
tgggatactgctggccaagaa

SEQ ID NO: 1844 - DNA, 23 bp, Chilo suppressalis
tgtgccatcatcatgttcgatgt

SEQ ID NO: 1845 - DNA, 21 bp, Chilo suppressalis
ttgactggagagttcgagaaa

SEQ ID NO: 1846 - DNA, 22 bp, Chilo suppressalis
ttgactggagagttcgagaaaa

SEQ ID NO: 1847 - DNA, 21 bp, Chilo suppressalis
tgggatactgctggccaagaa

SEQ ID NO: 1848 - DNA, 23 bp, Chilo suppressalis
gatcccattcagtctgtcaaggg

SEQ ID NO: 1849 - DNA, 29 bp, Chilo suppressalis
ttccaagcaaagatgttggatatgttgaa

SEQ ID NO: 1850 - DNA, 29 bp, Chilo suppressalis
aaaaagatccaatcttcgaacatgctgaa

SEQ ID NO: 1851 - DNA, 23 bp, Chilo suppressalis
aaacaagtggaactccagaaaaa

SEQ ID NO: 1852 - DNA, 23 bp, Chilo suppressalis
aaagtgcgtgaggaccacgtacg

SEQ ID NO: 1853 - DNA, 23 bp, Chilo suppressalis
aagatcagcaacactctggagtc

SEQ ID NO: 1854 - DNA, 26 bp, Chilo suppressalis
aagatcagcaacactctggagtctcg

SEQ ID NO: 1855 - DNA, 21 bp, Chilo suppressalis
aagatccaatcttcgaacatg

SEQ ID NO: 1856 - DNA, 26 bp, Chilo suppressalis
aagatccaatcttcgaacatgctgaa

SEQ ID NO: 1857 - DNA, 35 bp, Chilo suppressalis
aagcagatcaagcatatgatggccttcatcgaaca

SEQ ID NO: 1858 - DNA, 41 bp, Chilo suppressalis
aagcagatcaagcatatgatggccttcatcgaacaagaggc

SEQ ID NO: 1859 - DNA, 23 bp, Chilo suppressalis
atgatggccttcatcgaacaaga

SEQ ID NO: 1860 - DNA, 26 bp, Chilo suppressalis
atgatggccttcatcgaacaagaggc

SEQ ID NO: 1861 - DNA, 29 bp, Chilo suppressalis
cagatcaagcatatgatggccttcatcga

SEQ ID NO: 1862 - DNA, 29 bp, Chilo suppressalis
cagcagcggctcaagatcatggaatacta

SEQ ID NO: 1863 - DNA, 29 bp, Chilo suppressalis
catatgatggccttcatcgaacaagaggc

SEQ ID NO: 1864 - DNA, 23 bp, Chilo suppressalis
ctcaaagtgcgtgaggaccacgt

SEQ ID NO: 1865 - DNA, 23 bp, Chilo suppressalis
ctcaagatcatggaatactacga

SEQ ID NO: 1866 - DNA, 32 bp, Chilo suppressalis
gaaatcgatgcaaaggccgaagaggagttcaa

SEQ ID NO: 1867 - DNA, 23 bp, Chilo suppressalis
gaactccagaaaaagatccaatc

SEQ ID NO: 1868 - DNA, 38 bp, Chilo suppressalis
gaactccagaaaaagatccaatcttcgaacatgctgaa

SEQ ID NO: 1869 - DNA, 23 bp, Chilo suppressalis
gaggaaatcgatgcaaaggccga

SEQ ID NO: 1870 - DNA, 29 bp, Chilo suppressalis
gccgaagaggagttcaacattgaaaaagg

SEQ ID NO: 1871 - DNA, 21 bp, Chilo suppressalis
gcgcctggctgaggtgcccaa

SEQ ID NO: 1872 - DNA, 23 bp, Chilo suppressalis
ggccgcctggtgcagcagcagcg

SEQ ID NO: 1873 - DNA, 22 bp, Chilo suppressalis
ggctcaagatcatggaatacta

SEQ ID NO: 1874 - DNA, 25 bp, Chilo suppressalis
ggctcaagatcatggaatactacga

SEQ ID NO: 1875 - DNA, 23 bp, Chilo suppressalis
tacgaaaagaaagagaaacaagt

SEQ ID NO: 1876 - DNA, 25 bp, Chilo suppressalis
tgaaggtgctcaaagtgcgtgagga

SEQ ID NO: 1877 - DNA, 46 bp, Chilo suppressalis
ttcaaaagcagatcaagcatatgatggccttcatcgaacaagaggc

SEQ ID NO: 1878 - DNA, 23 bp, Chilo suppressalis
aacgggccggagatcatgtccaa

SEQ ID NO: 1879 - DNA, 23 bp, Chilo suppressalis
aactgccccgatgagaagatccg

SEQ ID NO: 1880 - DNA, 23 bp, Chilo suppressalis
atcttcatcgatgaactggatgc

SEQ ID NO: 1881 - DNA, 23 bp, Chilo suppressalis
catatattgcccattgatgattc

SEQ ID NO: 1882 - DNA, 26 bp, Chilo suppressalis
ctcatgtatgggccgcctggtaccgg

SEQ ID NO: 1883 - DNA, 30 bp, Chilo suppressalis
ctgccccgatgagaagatccgcatgaaccg

SEQ ID NO: 1884 - DNA, 23 bp, Chilo suppressalis
gagaagatccgcatgaaccgcgt

SEQ ID NO: 1885 - DNA, 21 bp, Chilo suppressalis
gtacatatattgcccattgat

SEQ ID NO: 1886 - DNA, 23 bp, Chilo suppressalis
tcatcgcacgtgatcgtaatggc

SEQ ID NO: 1887 - DNA, 21 bp, Chilo suppressalis
ttcatggttcgcgggggcatg

SEQ ID NO: 1888 - DNA, 32 bp, Chilo suppressalis
aaatcggtgtacatgtaacctgggaaaccacg

SEQ ID NO: 1889 - DNA, 22 bp, Chilo suppressalis
aagttgtcctcgtggtcgtcca

SEQ ID NO: 1890 - DNA, 21 bp, Chilo suppressalis
acagatctgggcggcaatttc

SEQ ID NO: 1891 - DNA, 26 bp, Chilo suppressalis
acagccttcatggcctgcacgtcctt

SEQ ID NO: 1892 - DNA, 26 bp, Chilo suppressalis
acatcagagtggtccttgcgggtcat

SEQ ID NO: 1893 - DNA, 26 bp, Chilo suppressalis
accagcacgtgtttctcacactggta

SEQ ID NO: 1894 - DNA, 23 bp, Chilo suppressalis
acctcctcacgggcggcggacac

SEQ ID NO: 1895 - DNA, 29 bp, Chilo suppressalis
acgacagccttcatggcctgcacgtcctt

SEQ ID NO: 1896 - DNA, 26 bp, Chilo suppressalis
acgtagatctgtccctcagtgatgta

SEQ ID NO: 1897 - DNA, 26 bp, Chilo suppressalis
agagcctccgcgtacgaagacatgtc

SEQ ID NO: 1898 - DNA, 21 bp, Chilo suppressalis
agcaatggagttcatcacgtc

SEQ ID NO: 1899 - DNA, 23 bp, Chilo suppressalis
agcagctgccagccgatgtccag

SEQ ID NO: 1900 - DNA, 23 bp, Chilo suppressalis
agcatctccttggggaagatacg

SEQ ID NO: 1901 - DNA, 35 bp, Chilo suppressalis
agggcttcctcaccgacgacagccttcatggcctg

SEQ ID NO: 1902 - DNA, 26 bp, Chilo suppressalis
ataccagtctggatcatttcctcagg

SEQ ID NO: 1903 - DNA, 26 bp, Chilo suppressalis
atacgggaccaggggttgatgggctg

SEQ ID NO: 1904 - DNA, 26 bp, Chilo suppressalis
atagcggagataccagtctggatcat

SEQ ID NO: 1905 - DNA, 23 bp, Chilo suppressalis
atctgggcggcaatttcgttgtg

SEQ ID NO: 1906 - DNA, 21 bp, Chilo suppressalis
atggcagacttcatgagacga

SEQ ID NO: 1907 - DNA, 29 bp, Chilo suppressalis
atggtggccaaatcggtgtacatgtaacc

SEQ ID NO: 1908 - DNA, 30 bp, Chilo suppressalis
atggtggccaaatcggtgtacatgtaacct

SEQ ID NO: 1909 - DNA, 41 bp, Chilo suppressalis
atggtggccaaatcggtgtacatgtaacctgggaaaccacg

SEQ ID NO: 1910 - DNA, 60 bp, Chilo suppressalis
attcaagaacaggcacacgttctccatggagccgttctcctcgaagtcctgcttgaagaa

SEQ ID NO: 1911 - DNA, 29 bp, Chilo suppressalis
attgggggacctttgtcaatgggttttcc

SEQ ID NO: 1912 - DNA, 47 bp, Chilo suppressalis
cacacgttctccatggagccgttctcctcgaagtcctgcttgaagaa

SEQ ID NO: 1913 - DNA, 23 bp, Chilo suppressalis
cactggtaggccaagaactcagc

SEQ ID NO: 1914 - DNA, 21 bp, Chilo suppressalis
catctccttggggaagatacg

SEQ ID NO: 1915 - DNA, 23 bp, Chilo suppressalis
ccctcaccgatggcagacttcat

SEQ ID NO: 1916 - DNA, 23 bp, Chilo suppressalis
ccgatggcagacttcatgagacg

SEQ ID NO: 1917 - DNA, 40 bp, Chilo suppressalis
ccgtctccatgttcacacccatggcggcgaacacgatggc

SEQ ID NO: 1918 - DNA, 29 bp, Chilo suppressalis
ccgttctcctcgaagtcctgcttgaagaa

SEQ ID NO: 1919 - DNA, 31 bp, Chilo suppressalis
ccgttctcctcgaagtcctgcttgaagaacc

SEQ ID NO: 1920 - DNA, 50 bp, Chilo suppressalis
cgagcaatggagttcatcacgtcgatagcggagataccagtctggatcat

SEQ ID NO: 1921 - DNA, 44 bp, Chilo suppressalis
cgggccgtctccatgttcacacccatggcggcgaacacgatggc

SEQ ID NO: 1922 - DNA, 26 bp, Chilo suppressalis
cgtccgggcacctcctcacgggcggc

SEQ ID NO: 1923 - DNA, 32 bp, Chilo suppressalis
cgtccgggcacctcctcacgggcggcggacac

SEQ ID NO: 1924 - DNA, 23 bp, Chilo suppressalis
ctacagatctgggcggcaatttc

SEQ ID NO: 1925 - DNA, 29 bp, Chilo suppressalis
ctacagatctgggcggcaatttcgttgtg

SEQ ID NO: 1926 - DNA, 21 bp, Chilo suppressalis
ctcgtagatggtggccaaatc

SEQ ID NO: 1927 - DNA, 33 bp, Chilo suppressalis
ctcgtagatggtggccaaatcggtgtacatgta

SEQ ID NO: 1928 - DNA, 36 bp, Chilo suppressalis
ctcgtagatggtggccaaatcggtgtacatgtaacc

SEQ ID NO: 1929 - DNA, 48 bp, Chilo suppressalis
ctcgtagatggtggccaaatcggtgtacatgtaacctgggaaaccacg

SEQ ID NO: 1930 - DNA, 24 bp, Chilo suppressalis
gaacaggcacacgttctccatgga

SEQ ID NO: 1931 - DNA, 29 bp, Chilo suppressalis
gactcgaatactgtgcggttctcgtagtt

SEQ ID NO: 1932 - DNA, 35 bp, Chilo suppressalis
gacttcatgagacgagacagggaaggcagcacgtt

SEQ ID NO: 1933 - DNA, 23 bp, Chilo suppressalis
gagataccagtctggatcatttc

SEQ ID NO: 1934 - DNA, 26 bp, Chilo suppressalis
gagataccagtctggatcatttcctc

SEQ ID NO: 1935 - DNA, 23 bp, Chilo suppressalis
gatgaagttcttctcgaacttgg

SEQ ID NO: 1936 - DNA, 24 bp, Chilo suppressalis
gatgaagttcttctcgaacttggt

SEQ ID NO: 1937 - DNA, 44 bp, Chilo suppressalis
gatgaagttcttctcgaacttggtgaggaactcgaggtagagca

SEQ ID NO: 1938 - DNA, 21 bp, Chilo suppressalis
gatggggatctgcgtgatgga

SEQ ID NO: 1939 - DNA, 27 bp, Chilo suppressalis
gcacacgttctccatggagccgttctc

SEQ ID NO: 1940 - DNA, 44 bp, Chilo suppressalis
gccaaatcggtgtacatgtaacctgggaaaccacgtcgtccggg

SEQ ID NO: 1941 - DNA, 22 bp, Chilo suppressalis
gccaagaactcagcagcagtca

SEQ ID NO: 1942 - DNA, 22 bp, Chilo suppressalis
gccgtctccatgttcacaccca

SEQ ID NO: 1943 - DNA, 23 bp, Chilo suppressalis
gccgtctccatgttcacacccat

SEQ ID NO: 1944 - DNA, 29 bp, Chilo suppressalis
gcctgcacgtccttaccgatggcgtagca

SEQ ID NO: 1945 - DNA, 23 bp, Chilo suppressalis
gccttcatggcctgcacgtcctt

SEQ ID NO: 1946 - DNA, 38 bp, Chilo suppressalis
gccttcatggcctgcacgtccttaccgatggcgtagca

SEQ ID NO: 1947 - DNA, 23 bp, Chilo suppressalis
gcggcgaacacgatggcaaagtt

SEQ ID NO: 1948 - DNA, 32 bp, Chilo suppressalis
gcggcgaacacgatggcaaagttgtcctcgtg

SEQ ID NO: 1949 - DNA, 23 bp, Chilo suppressalis
gcgtacagctggttggaaacatc

SEQ ID NO: 1950 - DNA, 35 bp, Chilo suppressalis; identical to SEQ ID NO: 409

SEQ ID NO: 1951 - DNA, 37 bp, Chilo suppressalis; identical to SEQ ID NO: 410

SEQ ID NO: 1952 - DNA, 26 bp, Chilo suppressalis
ggatgggtgatgtcgtcgttgggcat

SEQ ID NO: 1953 - DNA, 32 bp, Chilo suppressalis
ggcagaccggcagccgagaaaatggggatctt

SEQ ID NO: 1954 - DNA, 23 bp, Chilo suppressalis
ggcatagtcaagatggggatctg

SEQ ID NO: 1955 - DNA, 27 bp, Chilo suppressalis
ggccgtctccatgttcacacccatggc

SEQ ID NO: 1956 - DNA, 23 bp, Chilo suppressalis
ggcgggtagatctgtctgttgtg

SEQ ID NO: 1957 - DNA, 56 bp, Chilo suppressalis
ggcgggtagatctgtctgttgtggagctgacggtctacgtagatctgtccctcagt

SEQ ID NO: 1958 - DNA, 23 bp, Chilo suppressalis
gggaagatacggagcagctgcca

SEQ ID NO: 1959 - DNA, 29 bp, Chilo suppressalis
gggttgatgggctgtccctggatgtccaa

SEQ ID NO: 1960 - DNA, 23 bp, Chilo suppressalis
ggttttccagagccgttgaatac

SEQ ID NO: 1961 - DNA, 26 bp, Chilo suppressalis
gtgatgaagttcttctcgaacttggt

SEQ ID NO: 1962 - DNA, 23 bp, Chilo suppressalis
gtgcggttctcgtagttgccctg

SEQ ID NO: 1963 - DNA, 26 bp, Chilo suppressalis
gtggccaaatcggtgtacatgtaacc

SEQ ID NO: 1964 - DNA, 26 bp, Chilo suppressalis
gtgtacatgtaacctgggaaaccacg

SEQ ID NO: 1965 - DNA, 29 bp, Chilo suppressalis
gtgtacatgtaacctgggaaaccacgtcg

SEQ ID NO: 1966 - DNA, 53 bp, Chilo suppressalis
gtgtacatgtaacctgggaaaccacgtcgtccgggcacctcctcacgggcggc

SEQ ID NO: 1967 - DNA, 23 bp, Chilo suppressalis
tcagagtggtccttgcgggtcat

SEQ ID NO: 1968 - DNA, 26 bp, Chilo suppressalis
tcagcaaggattgggggacctttgtc

SEQ ID NO: 1969 - DNA, 29 bp, Chilo suppressalis
tcctcaccgacgacagccttcatggcctg

SEQ ID NO: 1970 - DNA, 23 bp, Chilo suppressalis
tcctcagggtagatacgggacca

SEQ ID NO: 1971 - DNA, 38 bp, Chilo suppressalis
tcctcagggtagatacgggaccaggggttgatgggctg

SEQ ID NO: 1972 - DNA, 22 bp, Chilo suppressalis
tcgaagtcctgcttgaagaacc

SEQ ID NO: 1973 - DNA, 35 bp, Chilo suppressalis
tcgtagatggtggccaaatcggtgtacatgtaacc

SEQ ID NO: 1974 - DNA, 47 bp, Chilo suppressalis
tcgtagatggtggccaaatcggtgtacatgtaacctgggaaaccacg

SEQ ID NO: 1975 - DNA, 29 bp, Chilo suppressalis
tctacgtagatctgtccctcagtgatgta

SEQ ID NO: 1976 - DNA, 26 bp, Chilo suppressalis
tgcacgtccttaccgatggcgtagca

SEQ ID NO: 1977 - DNA, 23 bp, Chilo suppressalis
tgggtgatgtcgtcgttgggcat

SEQ ID NO: 1978 - DNA, 23 bp, Chilo suppressalis
tggtaggccaagaactcagcagc

SEQ ID NO: 1979 - DNA, 26 bp, Chilo suppressalis
ttcaagaacaggcacacgttctccat

SEQ ID NO: 1980 - DNA, 29 bp, Chilo suppressalis
ttcaagaacaggcacacgttctccatgga

SEQ ID NO: 1981 - DNA, 23 bp, Chilo suppressalis
ttctcacactggtaggccaagaa

SEQ ID NO: 1982 - DNA, 26 bp, Chilo suppressalis
ttctcctcgaagtcctgcttgaagaa

SEQ ID NO: 1983 - DNA, 26 bp, Chilo suppressalis
ttgagcatctccttggggaagatacg

SEQ ID NO: 1984 - DNA, 31 bp, Chilo suppressalis
ttgagcatctccttggggaagatacggagca

SEQ ID NO: 1985 - DNA, 38 bp, Chilo suppressalis
ttgagcatctccttggggaagatacggagcagctgcca

SEQ ID NO: 1986 - DNA, 47 bp, Chilo suppressalis
ttgagcatctccttggggaagatacggagcagctgccagccgatgtc

SEQ ID NO: 1987 - DNA, 21 bp, Chilo suppressalis
tccgactactcttccacggac

SEQ ID NO: 1988 - DNA, 21 bp, Chilo suppressalis
atacaagctgtgcaaggtgcg

SEQ ID NO: 1989 - DNA, 23 bp, Chilo suppressalis
aagcacattgacttctcgctgaa

SEQ ID NO: 1990 - DNA, 21 bp, Chilo suppressalis
cgcaacaagcgtgaggtgtgg

SEQ ID NO: 1991 - DNA, 24 bp, Chilo suppressalis
cgtctccagactcaggtgttcaag

SEQ ID NO: 1992 - DNA, 23 bp, Chilo suppressalis
tttaatgtatgggatactgctgg

SEQ ID NO: 1993 - DNA, 25 bp, Chilo suppressalis
cacttgactggagagttcgagaaaa

SEQ ID NO: 1994 - DNA, 25 bp, Chilo suppressalis
ctcgtgtcacctacaaaaatgtacc

SEQ ID NO: 1995 - DNA, 23 bp, Chilo suppressalis
cacttgactggagagttcgagaa

SEQ ID NO: 1996 - DNA, 22 bp, Chilo suppressalis
taggtgaatttgttgatgatta

SEQ ID NO: 1997 - DNA, 23 bp, Chilo suppressalis
aagaaagagaaacaagtggaact

SEQ ID NO: 1998 - DNA, 26 bp, Chilo suppressalis
gtgtacatgtaacctgggaaaccacg

SEQ ID NO: 1999 - DNA, 23 bp, Chilo suppressalis
gtgtacatgtaacctgggaaacc

SEQ ID NO: 2000 - DNA, 23 bp, Chilo suppressalis
gccaaatcggtgtacatgtaacc

SEQ ID NO: 2001 - DNA, 29 bp, Chilo suppressalis
aagttcttctcgaacttggtgaggaactc

SEQ ID NO: 2002 - DNA, 21 bp, Chilo suppressalis
tggtctccgcaacaagcgtga

SEQ ID NO: 2003 - DNA, 21 bp, Chilo suppressalis
ggtctccgcaacaagcgtgag

SEQ ID NO: 2004 - DNA, 24 bp, Chilo suppressalis
tggtctccgcaacaagcgtgaggt

SEQ ID NO: 2005 - DNA, 24 bp, Chilo suppressalis
tggtctccgcaacaagcgtgaggt

SEQ ID NO: 2006 - DNA, 23 bp, Chilo suppressalis
ggtctccgcaacaagcgtgaggt

SEQ ID NO: 2007 - DNA, 28 bp, Chilo suppressalis
tggtctccgcaacaagcgtgaggtgtgg

SEQ ID NO: 2008 - DNA, 21 bp, Chilo suppressalis
cgcaacaagcgtgaggtgtgg

SEQ ID NO: 2009 - DNA, 23 bp, Chilo suppressalis
tcccctctcgtatgacaattggt

SEQ ID NO: 2010 - DNA, 21 bp, Chilo suppressalis
atttagctttgacaaagaata

SEQ ID NO: 2011 - DNA, 23 bp, Chilo suppressalis
gagcacccttcagaagttcaaca

SEQ ID NO: 2012 - DNA, 21 bp, Chilo suppressalis
tgggatactgctggccaagaa

SEQ ID NO: 2013 - DNA, 29 bp, Chilo suppressalis
aagtttggtggtctccgagatggttacta

SEQ ID NO: 2014 - DNA, 23 bp, Chilo suppressalis
caatgtgccatcatcatgttcga

SEQ ID NO: 2015 - DNA, 21 bp, Chilo suppressalis
catcatcatgttcgatgtaac

SEQ ID NO: 2016 - DNA, 23 bp, Chilo suppressalis
cacttgactggagagttcgagaa

SEQ ID NO: 2017 - DNA, 23 bp, Chilo suppressalis
tgaaggttcttttttctgtggaa

SEQ ID NO: 2018 - DNA, 23 bp, Chilo suppressalis
ggatggtaccactcgcatcctgg

SEQ ID NO: 2019 - DNA, 21 bp, Chilo suppressalis
aacgagaggaagaagaagaag

SEQ ID NO: 2020 - DNA, 22 bp, Chilo suppressalis
agggcttcttcttcttcctctc

SEQ ID NO: 2021 - DNA, 21 bp, Chilo suppressalis
tagggcttcttcttcttcctc

SEQ ID NO: 2022 - DNA, 21 bp, Chilo suppressalis
gagatggtcgagttgcctcta

SEQ ID NO: 2023 - DNA, 21 bp, Chilo suppressalis
gctgaagactttttggacatc

SEQ ID NO: 2024 - DNA, 25 bp, Chilo suppressalis
cctcaccaagttcgagaagaacttc

SEQ ID NO: 2025 - DNA, 21 bp, Chilo suppressalis
gtcgtcggtgaggaagccctg

SEQ ID NO: 2026 - DNA, 27 bp, Chilo suppressalis
tcctcaccgacgacagccttcatggcc

SEQ ID NO: 2027 - DNA, 24 bp, Chilo suppressalis
gatgtttccaaccagctgtacgcc

SEQ ID NO: 2028 - DNA, 24 bp, Chilo suppressalis
ggcgtacagctggttggaaacatc

SEQ ID NO: 2029 - DNA, 25 bp, Chilo suppressalis
tgatgtttccaaccagctgtacgcc

SEQ ID NO: 2030 - DNA, 23 bp, Chilo suppressalis
atggcagacttcatgagacgaga

SEQ ID NO: 2031 - DNA, 23 bp, Chilo suppressalis
atgcccaacgacgacatcaccca

SEQ ID NO: 2032 - DNA, 23 bp, Chilo suppressalis
tgggtgatgtcgtcgttgggcat

SEQ ID NO: 2033 - DNA, 23 bp, Chilo suppressalis
actatgcccaacgacgacatcac

SEQ ID NO: 2034 - DNA, 21 bp, Chilo suppressalis
ggttacatgtacaccgatttg

SEQ ID NO: 2035 - DNA, 24 bp, Chilo suppressalis
cccaggttacatgtacaccgattt

SEQ ID NO: 2036 - DNA, 21 bp, Chilo suppressalis
acaccacgtttggccttgact

SEQ ID NO: 2037 - DNA, 23 bp, Chilo suppressalis
gccatgggtgtgaacatggagac

SEQ ID NO: 2038 - DNA, 34 bp, Chilo suppressalis
gacgaccacgaggacaactttgccatcgtgttcg

SEQ ID NO: 2039 - DNA, 23 bp, Chilo suppressalis
aagatccccattttctcggctgc

SEQ ID NO: 2040 - DNA, 697 bp, Chilo suppressalis
taaagcatggatgttggacaaactgggtggcgtgtacgcgccgcggccgtcgaccggcccccacaagttgcgcgagtgcctgccgctggtgatcttcctcaggaaccggctcaagtacgcgctcaccggaaatgaagtgcttaagattgtaaagcagcgacttatcaaagttgacggcaaagtcaggacagaccccacatatcccgctggatttatggatgttgtttccattgaaaagacaaatgagctgttccgtcttatatatgatgtcaaaggcagatttactattcaccgtattactcctgaggaggctaaatacaagctgtgcaaggtgcggcgcgtggcgacgggccccaagaacgtgccttacctggtgacccacgacggacgcaccgtgcgataccccgacccactcatcaaggtcaacgactccatccagctcgacatcgccacctccaagatcatggacttcatcaagtttgaatctggtaacctatgtatgatcacgggaggccgtaacttggggcgcgtgggcaccatcgtgtcccgcgagcgacatcccgggtccttcgacatcgtgcatatacgggactccaccggacataccttcgctaccagattgaacaacgtgttcataatcggcaagggcacgaaggcgtacatctcgctgccgcgcggcaagggcgtgcgactcacc

SEQ ID NO: 2041 - DNA, 27 bp, Artificial Sequence
  synthetic oligo
taaagcatggatgttggacaaactggg

SEQ ID NO: 2042 - DNA, 43 bp, Artificial Sequence
  synthetic oligo
gcgtaatacgactcactataggggtgagtcgcacgcccttgcc

SEQ ID NO: 2043 - DNA, 49 bp, Artificial Sequence
  synthetic oligo
gcgtaatacgactcactataggtaaagcatggatgttggacaaactggg

SEQ ID NO: 2044 - DNA, 21 bp, Artificial Sequence
  synthetic oligo
ggtgagtcgcacgcccttgcc

SEQ ID NO: 2045 - DNA, 343 bp, Chilo suppressalis
caagaaggaggagaagggtccatcaacacacgaagctatacagaaattacgcgaaacggaagagttattgcagaagaaacaagagtttctagagcgaaagatcgacactgaattacaaacggcgagaaaacatggcacaaagaataagagagctgccattgcggcactgaagcgcaagaagcgttatgaaaagcagcttacccagattgatggcacgcttacccaaattgaggcccaaagggaagcgctagaaggagctaacaccaatacacaggtgcttaacactatgcgagatgctgctaccgctatgagactcgcccacaaggatatcgatgtagacaag

SEQ ID NO: 2046 - DNA, 27 bp, Artificial Sequence
  synthetic oligo
caagaaggaggagaagggtccatcaac

SEQ ID NO: 2047 - DNA, 49 bp, Artificial Sequence
  synthetic oligo
gcgtaatacgactcactataggcttgtctacatcgatatccttgtgggc

SEQ ID NO: 2048 - DNA, 49 bp, Artificial Sequence
  synthetic oligo
gcgtaatacgactcactataggcaagaaggaggagaagggtccatcaac

SEQ ID NO: 2049 - DNA, 27 bp, Artificial Sequence
  synthetic oligo
cttgtctacatcgatatccttgtgggc

SEQ ID NO: 2050 - DNA, 392 bp, Chilo suppressalis
tggtctccgcaacaagcgtgaggtgtggagggtgaagtacacgctggccaggatccgtaaggctgcccgtgagctgctcacactcgaggagaaagaccctaagaggttattcgaaggtaatgctctccttcgtcgtctggtgaggatcggtgtgttggatgagaagcagatgaagctcgattatgtactcggtctgaagattgaggacttcttggaacgtcgtctccagactcaggtgttcaaggctggtctagctaagtctatccatcatgcccgtattcttatcagacagaggcacatccgtgtccgcaagcaagttgtgaacatcccttcgttcatcgtgcggctggactctggcaagcacattgacttctcgctgaagtctccgttcg

SEQ ID NO: 2051 - DNA, 23 bp, Artificial Sequence
  synthetic oligo
tggtctccgcaacaagcgtgagg

SEQ ID NO: 2052 - DNA, 48 bp, Artificial Sequence
  synthetic oligo
gcgtaatacgactcactataggcgaacggagacttcagcgagaagtca

SEQ ID NO: 2053 - DNA, 45 bp, Artificial Sequence
  synthetic oligo
gcgtaatacgactcactataggtggtctccgcaacaagcgtgagg

SEQ ID NO: 2054 - DNA, 26 bp, Artificial Sequence
  synthetic oligo
cgaacggagacttcagcgagaagtca

SEQ ID NO: 2055 - DNA, 467 bp, Chilo suppressalis
ggatgatgatggtataattgcaccagggattcgtgtatctggtgacgatgtagtcattggaaaaactataactttgccagaaaacgatgatgagctggaaggaacatcaagacgatacagtaagagagatgcctctacattcttgcgaaacagtgaaactggtattgttgaccaagttatgcttacacttaacagcgaaggatacaaattttgtaaaatacgtgtgagatctgtgagaatcccacaaattggagacaaatttgcttctcgtcatggtcaaaaagggacttgtggtattcaatataggcaagaagatatgcctttcacttgtgaaggattgacaccagatattatcatcaatccacatgctatcccctctcgtatgacaattggtcacttgattgaatgtattcaaggtaaggtctcctcaaataaaggtgaaataggtgatgctacaccatttaacg

SEQ ID NO: 2056 - DNA, 28 bp, Artificial Sequence
  synthetic oligo
ggatgatgatggtataattgcaccaggg

SEQ ID NO: 2057 - DNA, 53 bp, Artificial Sequence
  synthetic oligo
gcgtaatacgactcactataggcgttaaatggtgtagcatcacctatttcacc

SEQ ID NO: 2058 - DNA, 50 bp, Artificial Sequence
  synthetic oligo
gcgtaatacgactcactataggggatgatgatggtataattgcaccaggg

SEQ ID NO: 2059 - DNA, 31 bp, Artificial Sequence
  synthetic oligo
cgttaaatggtgtagcatcacctatttcacc

SEQ ID NO: 2060 - DNA, 947 bp, Chilo suppressalis
cttgttgaaaccagagattttgagggctatcgtcgattgcggtttcgagcacccttcagaagttcaacatgaatgtattccccaagctgttttgggaatggatattctttgtcaaagctaaatccggaatgggaaaaaccgccgtatttgttttagcaacactgcaacagctagaaccttcagaaaaccatgtttacgtattagtaatgtgccatacaagggaactcgctttccaaataagcaaggaatatgagaggttctctaaatatatggctggtgttagagtatctgtattctttggtgggatgccaattcagaaagatgaagaagtattgaagacagcctgcccgcacatcgttgttggtactcctggcagaatattagcattggttaacaacaagaaactgaatttaaaacacctgaaacacttcatcctggatgaatgtgacaaaatgcttgaatctctagacatgagacgtgatgtgcaggaaatattcaggaacacccctcacggtaagcaggtcatgatgttttctgcaacattgagtaaggagatcagaccagtctgtaagaaatttatgcaagatcctatggaagtttatgtggatgatgaagctaaacttacattgcacggtttgcagcaacattatgttaaactcaaggaaaatgaaaagaataagaagttatttgaacttttggatgtactggagttcaaccaagttgtcatatttgtaaagtcagtgcagcgctgcatagctctcgcacagctgctgacagaccaaaacttcccagctattggtatacaccgaaatatgactcaagatgagcgtctctcccgctatcagcagttcaaagatttccagaagaggatccttgttgcgacaaatctttttggacggggtatggacattgaaagagtcaacatagtcttcaattatgacatgccg

SEQ ID NO: 2061 - DNA, 27 bp, Artificial Sequence
  synthetic oligo
cttgttgaaaccagagattttgagggc

SEQ ID NO: 2062 - DNA, 54 bp, Artificial Sequence
  synthetic oligo
gcgtaatacgactcactataggcggcatgtcataattgaagactatgttgactc

SEQ ID NO: 2063 - DNA, 49 bp, Artificial Sequence
  synthetic oligo
gcgtaatacgactcactataggcttgttgaaaccagagattttgagggc

SEQ ID NO: 2064 - DNA, 32 bp, Artificial Sequence
  synthetic oligo
cggcatgtcataattgaagactatgttgactc

SEQ ID NO: 2065 - DNA, 481 bp, Chilo suppressalis
acgtttctgcagcggctggactcacgggagcccatgtggcagctggacgagagcatcatcggcaccaaccccgggctcggcttccggcccacgccgccagaggtcgccagcagcgtcatctggtataaaggcaacgaccccaacagccaacaattctgggtgcaagaaacctccaactttctaaccgcgtacaaacgagacggtaagaaagcaggagcaggccagaacatccacaactgtgatttcaaactgcctcctccggccggtaaggtgtgcgacgtggacatcagcgcctggagtccctgtgtagaggacaagcactttggataccacaagtccacgccctgcatcttcctcaaactcaacaagatcttcggctggaggccgcacttctacaacagctccgacagcctgcccactgacatgcccgacgacttgaaggagcacatcaggaatatgacagcgtacgataagaattatc

SEQ ID NO: 2066 - DNA, 23 bp, Artificial Sequence
  synthetic oligo
acgtttctgcagcggctggactc

SEQ ID NO: 2067 - DNA, 54 bp, Artificial Sequence
  synthetic oligo
gcgtaatacgactcactatagggataattcttatcgtacgctgtcatattcctg

SEQ ID NO: 2068 - DNA, 45 bp, Artificial Sequence
  synthetic oligo
gcgtaatacgactcactataggacgtttctgcagcggctggactc

SEQ ID NO: 2069 - DNA, 32 bp, Artificial Sequence
  synthetic oligo
gataattcttatcgtacgctgtcatattcctg

SEQ ID NO: 2070 - DNA, 441 bp, Chilo suppressalis
cgacacttgactggagagttcgagaaaagatatgtcgccacattaggtgtcgaggtgcatcccttagtattccacacaaatagaggccctataaggtttaatgtatgggatactgctggccaagaaaagtttggtggtctccgagatggttactatatccaaggtcaatgtgccatcatcatgttcgatgtaacgtctcgtgtcacctacaaaaatgtacccaactggcacagagatttagtgcgagtctgtgaaggcattccaattgttctttgtggcaacaaagtagatatcaaggacagaaaagtcaaagcaaaaactattgttttccacagaaaaaagaaccttcagtattatgacatctctgccaagtcaaactacaatttcgagaaacccttcctctggttagcgagaaagttgatcggtgatggtaacctagag

SEQ ID NO: 2071 - DNA, 25 bp, Artificial Sequence
  synthetic oligo
cgacacttgactggagagttcgaga

SEQ ID NO: 2072 - DNA, 48 bp, Artificial Sequence
  synthetic oligo
gcgtaatacgactcactataggctctaggttaccatcaccgatcaact

SEQ ID NO: 2073 - DNA, 47 bp, Artificial Sequence
  synthetic oligo
gcgtaatacgactcactataggcgacacttgactggagagttcgaga

SEQ ID NO: 2074 - DNA, 26 bp, Artificial Sequence
  synthetic oligo
ctctaggttaccatcaccgatcaact

SEQ ID NO: 2075 - DNA, 353 bp, Chilo suppressalis
tgccgaacaggtatacatctcgtctttggccctgttgaagatgttaaaacacgggcgcgccggtgttccaatggaagttatgggacttatgttaggtgaatttgttgatgattacacggtgcgtgtcatagacgtatttgccatgcctcaaactggcacaggagtgtcggttgaagctgtagatcctgtcttccaagcaaagatgttggatatgttgaagcaaactggacgacctgagatggtagtgggatggtaccactcgcatcctggctttggatgttggttatctggagtcgacattaatactcagcagtctttcgaagctttgtctgaacgtgctgtagctgtagtgg

SEQ ID NO: 2076 - DNA, 29 bp, Artificial Sequence
  synthetic oligo
tgccgaacaggtatacatctcgtctttgg

SEQ ID NO: 2077 - DNA, 48 bp, Artificial Sequence
  synthetic oligo
gcgtaatacgactcactataggccactacagctacagcacgttcagac

SEQ ID NO: 2078 - DNA, 51 bp, Artificial Sequence
  synthetic oligo
gcgtaatacgactcactataggtgccgaacaggtatacatctcgtctttgg

SEQ ID NO: 2079 - DNA, 26 bp, Artificial Sequence
  synthetic oligo
ccactacagctacagcacgttcagac

SEQ ID NO: 2080 - DNA, 617 bp, Chilo suppressalis
agatcaagcatatgatggccttcatcgaacaagaggctaatgaaaaggccgaggaaatcgatgcaaaggccgaagaggagttcaacattgaaaaaggccgcctggtgcagcagcagcggctcaagatcatggaatactacgaaaagaaagagaaacaagtggaactccagaaaaagatccaatcttcgaacatgctgaatcaagcccgtctgaaggtgctcaaagtgcgtgaggaccacgtacgcaacgttctcgacgaggctcgcaagcgcctggctgaggtgcccaaagacgtgaaactttacacagatctgctggtcacgctcgtcgtacaagccctattccagctcatggaacccacagtaacagttcgcgttaggcaggcggacgtctccttagtacagtccatattgggcaaggcacagcaggattacaaagcaaagatcaagaaggacgttcaattgaagatcgacaccgagaattccctgcccgccgatacttgtggcggagtggaacttattgctgctagagggcgtattaagatcagcaacactctggagtctcgtctggagctgatagcccaacaactgttgcccgaaatacgtaccgcattgttc

SEQ ID NO: 2081 - DNA, 29 bp, Artificial Sequence
  synthetic oligo
cagatcaagcatatgatggccttcatcga

SEQ ID NO: 2082 - DNA, 47 bp, Artificial Sequence
  synthetic oligo
gcgtaatacgactcactatagggaacaatgcggtacgtatttcgggc

SEQ ID NO: 2083 - DNA, 51 bp, Artificial Sequence
  synthetic oligo
gcgtaatacgactcactataggcagatcaagcatatgatggccttcatcga

SEQ ID NO: 2084 - DNA, 25 bp, Artificial Sequence
  synthetic oligo
gaacaatgcggtacgtatttcgggc

SEQ ID NO: 2085 - DNA, 826 bp, Chilo suppressalis
atcgtgctttcagacgataactgccccgatgagaagatccgcatgaaccgcgtcgtgcgaaacaacttgcgtgtacgcctgtcagacatagtctccatagcgccttgtccatcggtcaaatatgggaaacgggtacatatattgcccattgatgattctgtcgagggtttgactggaaatttattcgaagtctacttgaaaccatacttcatggaagcttatcggcctatccatcgcgatgacacattcatggttcgcgggggcatgagggctgttgaattcaaagtggtggagactgatccgtcgccgtattgcatcgtcgctcccgacacagtgatacactgcgaaggagaccctatcaaacgagaggaagaagaagaagccctaaacgccgtagggtacgacgacatcggtggctgtcgtaaacagctcgctcagatcaaagagatggtcgagttgcctctaaggcatccgtcgctgttcaaggcaattggtgtgaagccgccacgtggaatcctcatgtatgggccgcctggtaccggcaaaactctcattgctcgggcagtggctaatgaaactggtgcattcttctttctgatcaacgggccggagatcatgtccaaactcgcgggcgagtccgaatcgaaccttcgcaaggcattcgaggaagcggacaagaactccccggctataatcttcatcgatgaactggatgccatcgcaccaaagagggagaagactcacggtgaagtggagcgtcgtattgtgtcgcaactacttactcttatggatggaatgaagaagtcatcgcacgtgatcgtaatgg

SEQ ID NO: 2086 - DNA, 27 bp, Artificial Sequence
  synthetic oligo
atcgtgctttcagacgataactgcccc

SEQ ID NO: 2087 - DNA, 48 bp, Artificial Sequence
  synthetic oligo
gcgtaatacgactcactataggccattacgatcacgtgcgatgacttc

SEQ ID NO: 2088 - DNA, 49 bp, Artificial Sequence
  synthetic oligo
gcgtaatacgactcactataggatcgtgctttcagacgataactgcccc

SEQ ID NO: 2089 - DNA, 26 bp, Artificial Sequence
  synthetic oligo
ccattacgatcacgtgcgatgacttc

SEQ ID NO: 2090 - DNA, 1144 bp, Chilo suppressalis; identical to SEQ ID NO: 1702

SEQ ID NO: 2091 - DNA, 26 bp, Artificial Sequence
  synthetic oligo
aggatggaagcggggatacgtttgag

SEQ ID NO: 2092 - DNA, 47 bp, Artificial Sequence
  synthetic oligo
gcgtaatacgactcactatagggcacccctgtctccgaagacatgtt

SEQ ID NO: 2093 - DNA, 48 bp, Artificial Sequence
  synthetic oligo
gcgtaatacgactcactataggaggatggaagcggggatacgtttgag

SEQ ID NO: 2094 - DNA, 25 bp, Artificial Sequence
  synthetic oligo
gcacccctgtctccgaagacatgtt

SEQ ID NO: 2095 - DNA, 1153 bp, Chilo suppressalis
cgtccctgtacctgctcagcaatcccaacagcagcagagttaccgccacgtcagcgagagcgtcgaacacaaatcctacggcacgcaagggtacaccacttcggaacagaccaagcagacacagaaggtggcgtacaccaacggttccgactactcttccacggacgactttaaggtggatacgttcgaatacagactcctccgagaagtttcgttcagggaatccatcacgaagcggtacattggcgagacagacattcagatcagcacggaggtcgacaagtctctcggtgtggtgacccctcctaagatagcacaaaagcctaggaattccaagctgcaggagggagccgacgctcagtttcaagtgcagctgtcgggtaacccgcggccacgggtgtcatggttcaagaacgggcagaggatagtcaactcgaacaaacacgaaatcgtcacgacacataatcaaacaatacttagggtaagaaacacacaaaagtctgatactggcaactacacgttgttggctgaaaatcctaacggatgcgtcgtcacatcggcatacctggccgtggagtcgcctcaagaaacttacggccaagatcataaatcacaatacataatggacaatcagcaaacagctgtagaagaaagagtagaagttaatgaaaaagctctcgctccgcaattcgtaagagtctgccaagaccgcgatgtaacggaggggaaaatgacgcgattcgattgccgcgtcacgggcagaccttacccagaagtcacgtggttcattaacgatagacaaattcgagacgattatwatcataagatattagtaaacgaatcgtgtaatcatgcacttatgattacaaacgtcgatctcagtgatagtggcgtagtatcatgtatagcacgcaacaagaccggcgaaacttcgtttcagtgtaggctgaacgtgatagagaaggagcaagtggtcgctcccaaattcgtggagcggttcagcacgctcaacgtgcgcgagggcgagcccgtgcagctgcacgcgcgcgccgtcggcacgcctacgccacgcatcacatggcagaaggacggcgttcaagttatacccaatccagagctacgaataaataccgaaggtggggcctcgacgctg

SEQ ID NO: 2096 - DNA, 27 bp, Artificial Sequence
  synthetic oligo
cgtccctgtacctgctcagcaatccca

SEQ ID NO: 2097 - DNA, 42 bp, Artificial Sequence
  synthetic oligo
gcgtaatacgactcactataggcagcgtcgaggccccacctt

SEQ ID NO: 2098 - DNA, 49 bp, Artificial Sequence
  synthetic oligo
gcgtaatacgactcactataggcgtccctgtacctgctcagcaatccca

SEQ ID NO: 2099 - DNA, 20 bp, Artificial Sequence
  synthetic oligo
cagcgtcgaggccccacctt

SEQ ID NO: 2100 - DNA, 688 bp, Plutella xylostella
ggccccaagaagcatttgaagcgcctgaacgcgccgcgcgcatggatgctggacaagctcggcggcgtgtacgcgccgcggcccagcacgggcccgcacaagctgcgcgagtgcctgccgctcgtcatcttcctgcaaccgcctcaagtacgcgctcagcggcaacgaggtgctgaagatcgtgaagcagcgcctcatcaaggtggacggcaaggtccgcaccgaccccacctacccggctggattcatggatgttgtgtcgattgaaaagaccaatgagctgttccgtctgatctacgatgtgaagggacgcttcaccatccaccgcatcactcccgaggaggccaagtacaagctgtgcaaggtgaagcgcgtggcgacgggccccaagaacgtgccgtacatcgtgacgcacaacggccgcacgctgcgctaccccgacccgctcatcaaggtcaacgactccatccagctcgacatcgccacctgcaagatcatggacatcatcaagttcgactcaggtaacctgtgcatgatcacgggagggcgtaacttggggcgagtgggcaccatcgtgtcccgcgagaggcaccccgggagcttcgacatcgtccacatcaaggacaccaccggacacaccttcgccaccaggttgaacaacgtgttcatcatcggcaagggcacgaag

SEQ ID NO: 2101 - protein, 225 aa, Plutella xylostella
GPKKHLKRLNAPRAWMLDKLGGVYAPRPSTGPHKLRECLPLVIFLQPPQVRAQRQRGAEDREAAPHQGGRQGPHRPHLPGWIHGCCVDKDQAVPSDLRCEGTLHHPPHHSRGGQVQAVQGEARGDGPQERAVHRDAQRPHAALPRPAHQGQRLHPARHRHLQDHGHHQVRLRPVHDHGRALGASGHHRVPREAPRELRHRPHQGHHRTHLRHQVEQRVHHRQGHE

SEQ ID NO: 2102 - DNA, 580 bp, Plutella xylostella
gcacgttgatctggtacaaaggaaccggttacgacagctacaagtattgggagaaccagctcattgactttttgtcagtatacaagaagaagggtcagacagcgggtgctggtcagaacatcttcaactgtgacttccgcaacccgcccccacacggcaaggtgtgcgacgtggacatccgcggctgggagccctgcattgatgagaaccacttctctttccacaagtcttcgccttgcatcttcttgaagctgaataagatctacggctggcgtccagagttctacaacgacacggctaacctgcctgaagccatgcccgtggacttgcagacccacattcgtaacattactgccttcaacagagactatgcgaacatggtgtgggtgtcgtgccacggcgagacgccggcggacaaggagaacatcgggccggtgcgctacctgccctacccgggcttccccgggtacttctacccgtacgagaacgccgaggggtatctgagcccgctggtcgccgtgcatttggagaggccgaggaccggcatagtgatcaacatcgagtgcaaagcgtgggctgc

SEQ ID NO: 2103 - protein, 192 aa, Plutella xylostella
TLIWYKGTGYDSYKYWENQLIDFLSVYKKKGQTAGAGQNIFNCDFRNPPPHGKVCDVDIRGWEPCIDENHFSFHKSSPCIFLKLNKIYGWRPEFYNDTANLPEAMPVDLQTHIRNITAFNRDYANMVWVSCHGETPADKENIGPVRYLPYPGFPGYFYPYENAEGYLSPLVAVHLERPRTGIVINIECKAWA

SEQ ID NO: 2104 - DNA, 865 bp, Plutella xylostella
gtggctgcatacagttcattacgcagtaccagcactctagtggacaacgtcgcgttcgggtcaccactgtcgcgcgcaattggggcgacgcagccgccaacttacaccacatatcggcgggcttcgaccaggaggcggcggcggtggtgatggcgcggctggtggtgtaccgcgcggagcaggaggacgggcccgacgtgctgcgctggctcgaccgcatgctcatacgcctgtgccagaagttcggcgagtacgcgaaggacgacccgaacagcttccgtctgtcggagaacttcagcctgtacccgcagttcatgtaccacctgcgccgctcgcagttcctgcaggtcttcaacaactcgcccgacgagaccaccttctacagacacatgctgatgcgcgaagacctgacccaatccctcatcatgatccagccgatcctctactcgtacagcttcggaggcgcgcccgaacccgtgctgttagacaccagctccatccagcccgaccgcatcctgctcatggacaccttcttccagatcctcatctaccatggagagacaatggcgcaatggcgcgctctccgctaccaagacatggctgagtacgagaacttcaagcagctgctgcgagcgcccgtggacgacgcgcaggagatcctgcagaccaggttccccgtgccgcggtacattgatacagagcacggcggctcacaggcccggttcttgctttccaaagtgaatccctctcagactcacaacaacatgtacgcgtatggcggggcgatgccgataccatcagcggacggtggcgcccccgtgttgacggatgacgtgtcgctgcaagtgttcatggagcagccgcg

SEQ ID NO: 2105 - protein, 287 aa, Plutella xylostella
GCIQFITQYQHSSGQRRVRVTTVARNWGDAAANLHHISAGFDQEAAAVVMARLVVYRAEQEDGPDVLRWLDRMLIRLCQKFGEYAKDDPNSFRLSENFSLYPQFMYHLRRSQFLQVFNNSPDETTFYRHMLMREDLTQSLIMIQPILYSYSFGGAPEPVLLDTSSIQPDRILLMDTFFQILIYHGETMAQWRALRYQDMAEYENFKQLLRAPVDDAQEILQTRFPVPRYIDTEHGGSQARFLLSKVNPSQTHNNMYAYGGAMPIPSADGGAPVLTDDVSLQVFMEQP

SEQ ID NO: 2106 - DNA, 742 bp, Plutella xylostella
gccgcaaggagaccgtgtgcattgtgctgtccgacgacaactgccccgacgagaagatccgcatgaaccgcgtcgtccggaacaacctgcgagtgcgcctgtcagacattgtgtccatcgctccttgcccgtcagtgaagtacggcaagagagttcatattctgcccattgatgactctgttgagggtttgactggaaacctgttcgaagtctacctgaagccgtacttcatggaggcgtaccggcccatccaccgcgacgacacgttcatggtgcgcggcggcatgcgcgccgtcgagttcaaggtggtggagaccgacccctcgccctactgcatcgtggcccccgacacggtcattcattgtgagggagagccgattaaacgcgaggaagaagaggaggctctcaacgccgtcggctacgacgacatcggcgggtgccgcaagcagctggcgcagatcaaggagatggtggagctgccgctgcgccacccctcgctgttcaaggccatcggggtcaagccgccgcgggggatactgatgtacgggcccccggggacggggaagaccttgatcgctagggctgtcgctaatgagacgggcgcattcttcttcctcatcaacggccccgagatcatgtcgaaactcgccggtgaatccgagtcgaacctgcgcaaggcgttcgaggaggcggacaagaactctccggccatcatcctcattgatgaacttgatgccattgc

SEQ ID NO: 2107 - protein, 246 aa, Plutella xylostella
RKETVCIVLSDDNCPDEKIRMNRVVRNNLRVRLSDIVSIAPCPSVKYGKRVHILPIDDSVEGLTGNLFEVYLKPYFMEAYRPIHRDDTFMVRGGMRAVEFKVVETDPSPYCIVAPDTVIHCEGEPIKREEEEEALNAVGYDDIGGCRKQLAQIKEMVELPLRHPSLFKAIGVKPPRGILMYGPPGTGKTLIARAVANETGAFFFLINGPEIMSKLAGESESNLRKAFEEADKNSPAIILIDELDAI

SEQ ID NO: 2108 - DNA, 1138 bp, Plutella xylostella
gttcaccggcgatattctgcgcacgcccgtctctgaggacatgctgggtcgtattttcaacggctccggcaagcccatcgacaaggggcccccgatcctggccgaggagtacctggacatccaggggcagcccatcaacccgtggtcccgtatctacccggaggagatgatccagactggtatctccgctatcgacgtgatgaactccatcgcccgtggtcagaagatccccatcttctccgccgccggtctgccccacaacgagattgctgctcagatctgtaggcaggctggtcttgtcaaggtccccggaaaatccgtgttggacgaccacgaagacaacttcgccatcgtgttcgccgccatgggagtcaacatggagaccgccaggttcttcaagcaggacttcgaggagaacggttccatggagaacgtctgtctgttcttgaacttggccaatgacccgaccattgagaggattatcacgccgaggttggcgctgactgctgccgagttcttggcctaccagtgcgagaaacacgtgttggtaatcttgaccgacatgtcttcatacgcggaggctcttcgtgaagtgtcagccgcccgtgaggaggtgcccggacgacgtggtttcccaggttacatgtacacggatttggccacaatctacgagcgcgccgggcgagtcgagggccgcaacggctccatcacgcagatccccatcctgaccatgcccaacgacgacatcacccaccccatccccgacttgaccgggtacatcactgagggacagatctacgtggaccgtcagctgcacaacaggcagatctacccgccggtgaatgtgctcccgtcgctatctcgtctcatgaagtccgccatcggagagggcatgaccaggaaggaccactccgacgtgtccaaccaactgtacgcgtgctacgccatcggcaaggacgtgcaggcgatgaaggcggtggtgggcgaggaggcgctcacgcccgacgacctgctctacctcgagttcctcaccaagttcgagaagaacttcatcacacagggaagctacgagaaccgcacagtgttcgagtcgctggacatcggctggcagcccctgcgtatcttccccaaggagatg

SEQ ID NO: 2109 - protein, 379 aa, Plutella xylostella
FTGDILRTPVSEDMLGRIFNGSGKPIDKGPPILAEEYLDIQGQPINPWSRIYPEEMIQTGISAIDVMNSIARGQKIPIFSAAGLPHNEIAAQICRQAGLVKVPGKSVLDDHEDNFAIVFAAMGVNMETARFFKQDFEENGSMENVCLFLNLANDPTIERIITPRLALTAAEFLAYQCEKHVLVILTDMSSYAEALREVSAAREEVPGRRGFPGYMYTDLATIYERAGRVEGRNGSITQIPILTMPNDDITHPIPDLTGYITEGQIYVDRQLHNRQIYPPVNVLPSLSRLMKSAIGEGMTRKDHSDVSNQLYACYAIGKDVQAMKAVVGEEALTPDDLLYLEFLTKFEKNFITQGSYENRTVFESLDIGWQPLRIFPKEM

SEQ ID NO: 2110 - DNA, 23 bp, Artificial Sequence
  synthetic oligo
ggccccaagaagcatttgaagcg

SEQ ID NO: 2111 - DNA, 28 bp, Artificial Sequence
  synthetic oligo
cttcgtgcccttgccratkatraabacg

SEQ ID NO: 2112 - DNA, 26 bp, Artificial Sequence
  synthetic oligo
gcacgttgatctggtacarrggmacc

SEQ ID NO: 2113 - DNA, 20 bp, Artificial Sequence
  synthetic oligo
gcagcccacgcyytgcactc

SEQ ID NO: 2114 - DNA, 26 bp, Artificial Sequence
  synthetic oligo
gtggctgcatacagttcattacgcag

SEQ ID NO: 2115 - DNA, 23 bp, Artificial Sequence
  synthetic oligo
cgcggctgctccatgaayasytg

SEQ ID NO: 2116 - DNA, 20 bp, Artificial Sequence
  synthetic oligo
gccgcaaggagacbgtvtgc

SEQ ID NO: 2117 - DNA, 24 bp, Artificial Sequence
  synthetic oligo
gcaatggcatcaakytcrtcratg

SEQ ID NO: 2118 - DNA, 21 bp, Artificial Sequence
  synthetic oligo
gttcaccggcgayatyctgcg

SEQ ID NO: 2119 - DNA, 25 bp, Artificial Sequence
  synthetic oligo
catctccttggggaagatacgcagc

SEQ ID NO: 2120 - DNA, 32 bp, Plutella xylostella
aacaacgtgttcatcatcggcaagggcacgaa

SEQ ID NO: 2121 - DNA, 21 bp, Plutella xylostella
aacgtgttcatcatcggcaag

SEQ ID NO: 2122 - DNA, 22 bp, Plutella xylostella
aacgtgttcatcatcggcaagg

SEQ ID NO: 2123 - DNA, 23 bp, Plutella xylostella
aacgtgttcatcatcggcaaggg

SEQ ID NO: 2124 - DNA, 29 bp, Plutella xylostella
aacgtgttcatcatcggcaagggcacgaa

SEQ ID NO: 2125 - DNA, 29 bp, Plutella xylostella
aacttggggcgagtgggcaccatcgtgtc

SEQ ID NO: 2126 - DNA, 36 bp, Plutella xylostella
aacttggggcgagtgggcaccatcgtgtcccgcgag

SEQ ID NO: 2127 - DNA, 41 bp, Plutella xylostella
aagatcgtgaagcagcgcctcatcaaggtggacggcaaggt

SEQ ID NO: 2128 - DNA, 23 bp, Plutella xylostella
aaggtccgcaccgaccccaccta

SEQ ID NO: 2129 - DNA, 21 bp, Plutella xylostella
aagtacaagctgtgcaaggtg

SEQ ID NO: 2130 - DNA, 31 bp, Plutella xylostella
acaacgtgttcatcatcggcaagggcacgaa

SEQ ID NO: 2131 - DNA, 22 bp, Plutella xylostella
acggcaaggtccgcaccgaccc

SEQ ID NO: 2132 - DNA, 50 bp, Plutella xylostella
acggccgcacgctgcgctaccccgacccgctcatcaaggtcaacgactcc

SEQ ID NO: 2133 - DNA, 25 bp, Plutella xylostella
acgtgttcatcatcggcaagggcac

SEQ ID NO: 2134 - DNA, 21 bp, Plutella xylostella
aggaggccaagtacaagctgt

SEQ ID NO: 2135 - DNA, 28 bp, Plutella xylostella
aggaggccaagtacaagctgtgcaaggt

SEQ ID NO: 2136 - DNA, 29 bp, Plutella xylostella
aggaggccaagtacaagctgtgcaaggtg

SEQ ID NO: 2137 - DNA, 21 bp, Plutella xylostella
caacgtgttcatcatcggcaa

SEQ ID NO: 2138 - DNA, 26 bp, Plutella xylostella
caacgtgttcatcatcggcaagggca

SEQ ID NO: 2139 - DNA, 32 bp, Plutella xylostella
cacaccttcgccaccaggttgaacaacgtgtt

SEQ ID NO: 2140 - DNA, 21 bp, Plutella xylostella
ccccaagaagcatttgaagcg

SEQ ID NO: 2141 - DNA, 22 bp, Plutella xylostella
ccgaggaggccaagtacaagct

SEQ ID NO: 2142 - DNA, 31 bp, Plutella xylostella
ccgaggaggccaagtacaagctgtgcaaggt

SEQ ID NO: 2143 - DNA, 29 bp, Plutella xylostella
ccgcacaagctgcgcgagtgcctgccgct

SEQ ID NO: 2144 - DNA, 22 bp, Plutella xylostella
cgacgggccccaagaacgtgcc

SEQ ID NO: 2145 - DNA, 21 bp, Plutella xylostella
cgaggaggccaagtacaagct

SEQ ID NO: 2146 - DNA, 22 bp, Plutella xylostella
cgaggaggccaagtacaagctg

SEQ ID NO: 2147 - DNA, 27 bp, Plutella xylostella
cgagtgggcaccatcgtgtcccgcgag

SEQ ID NO: 2148 - DNA, 36 bp, Plutella xylostella
cgctaccccgacccgctcatcaaggtcaacgactcc

SEQ ID NO: 2149 - DNA, 23 bp, Plutella xylostella
cgcttcaccatccaccgcatcac

SEQ ID NO: 2150 - DNA, 24 bp, Plutella xylostella
cggcaacgaggtgctgaagatcgt

SEQ ID NO: 2151 - DNA, 23 bp, Plutella xylostella
cgtaacttggggcgagtgggcac

SEQ ID NO: 2152 - DNA, 24 bp, Plutella xylostella
ctacccggctggattcatggatgt

SEQ ID NO: 2153 - DNA, 21 bp, Plutella xylostella
ctcatcaaggtcaacgactcc

SEQ ID NO: 2154 - DNA, 35 bp, Plutella xylostella; identical to SEQ ID NO: 1744

SEQ ID NO: 2155 - DNA, 21 bp, Plutella xylostella
gacggcaaggtccgcaccgac

SEQ ID NO: 2156 - DNA, 23 bp, Plutella xylostella
gacggcaaggtccgcaccgaccc

SEQ ID NO: 2157 - DNA, 29 bp, Plutella xylostella
gaggaggccaagtacaagctgtgcaaggt

SEQ ID NO: 2158 - DNA, 30 bp, Plutella xylostella
gaggaggccaagtacaagctgtgcaaggtg

SEQ ID NO: 2159 - DNA, 23 bp, Plutella xylostella
gaggccaagtacaagctgtgcaa

SEQ ID NO: 2160 - DNA, 27 bp, Plutella xylostella
gaggccaagtacaagctgtgcaaggtg

SEQ ID NO: 2161 - DNA, 23 bp, Plutella xylostella
gccaagtacaagctgtgcaaggt

SEQ ID NO: 2162 - DNA, 22 bp, Plutella xylostella
gccccaagaagcatttgaagcg

SEQ ID NO: 2163 - DNA, 21 bp, Plutella xylostella
gcgcgtggcgacgggccccaa

SEQ ID NO: 2164 - DNA, 22 bp, Plutella xylostella
gcgcgtggcgacgggccccaag

SEQ ID NO: 2165 - DNA, 27 bp, Plutella xylostella
ggaggccaagtacaagctgtgcaaggt

SEQ ID NO: 2166 - DNA, 23 bp, Plutella xylostella
ggccccaagaagcatttgaagcg

SEQ ID NO: 2167 - DNA, 24 bp, Plutella xylostella
ggcggcgtgtacgcgccgcggccc

SEQ ID NO: 2168 - DNA, 23 bp, Plutella xylostella
gtccgcaccgaccccacctaccc

SEQ ID NO: 2169 - DNA, 26 bp, Plutella xylostella
gtgggcaccatcgtgtcccgcgagag

SEQ ID NO: 2170 - DNA, 31 bp, Plutella xylostella
tcaaggtggacggcaaggtccgcaccgaccc

SEQ ID NO: 2171 - DNA, 22 bp, Plutella xylostella
tgatctacgatgtgaagggacg

SEQ ID NO: 2172 - DNA, 26 bp, Plutella xylostella
ttcatggatgttgtgtcgattgaaaa

SEQ ID NO: 2173 - DNA, 21 bp, Plutella xylostella
gctggattcatggatgttgtg

SEQ ID NO: 2174 - DNA, 42 bp, Plutella xylostella
aagcagcgcctcatcaaggtggacggcaaggtccgcaccgac

SEQ ID NO: 2175 - DNA, 21 bp, Plutella xylostella
aacatcttcaactgtgacttc

SEQ ID NO: 2176 - DNA, 22 bp, Plutella xylostella
tgatcaacatcgagtgcaaagc

SEQ ID NO: 2177 - DNA, 22 bp, Plutella xylostella
ttcttgaagctgaataagatct

SEQ ID NO: 2178 - DNA, 23 bp, Plutella xylostella
cagttcctgcaggtcttcaacaa

SEQ ID NO: 2179 - DNA, 27 bp, Plutella xylostella
ccatcagcggacggtggcgcccccgtg

SEQ ID NO: 2180 - DNA, 37 bp, Plutella xylostella
cccgcagttcatgtaccacctgcgccgctcgcagttc

SEQ ID NO: 2181 - DNA, 32 bp, Plutella xylostella
ccgaacagcttccgtctgtcggagaacttcag

SEQ ID NO: 2182 - DNA, 28 bp, Plutella xylostella
cgcctgtgccagaagttcggcgagtacg

SEQ ID NO: 2183 - DNA, 26 bp, Plutella xylostella
ctgcgccgctcgcagttcctgcaggt

SEQ ID NO: 2184 - DNA, 23 bp, Plutella xylostella
ctgtacccgcagttcatgtacca

SEQ ID NO: 2185 - DNA, 23 bp, Plutella xylostella
gacgtgctgcgctggctcgaccg

SEQ ID NO: 2186 - DNA, 29 bp, Plutella xylostella
gacgtgtcgctgcaagtgttcatggagca

SEQ ID NO: 2187 - DNA, 28 bp, Plutella xylostella
gagtacgagaacttcaagcagctgctgc

SEQ ID NO: 2188 - DNA, 23 bp, Plutella xylostella
ggcggggcgatgccgataccatc

SEQ ID NO: 2189 - DNA, 35 bp, Plutella xylostella
gtggctgcatacagttcattacgcagtaccagcac

SEQ ID NO: 2190 - DNA, 26 bp, Plutella xylostella
tcgcagttcctgcaggtcttcaacaa

SEQ ID NO: 2191 - DNA, 34 bp, Plutella xylostella
tgcgccgctcgcagttcctgcaggtcttcaacaa

SEQ ID NO: 2192 - DNA, 52 bp, Plutella xylostella
tgcgccgctcgcagttcctgcaggtcttcaacaactcgcccgacgagaccac

SEQ ID NO: 2193 - DNA, 65 bp, Plutella xylostella
ttcatgtaccacctgcgccgctcgcagttcctgcaggtcttcaacaactcgcccgacgagaccac

SEQ ID NO: 2194 - DNA, 26 bp, Plutella xylostella
atcctgctcatggacaccttcttcca

SEQ ID NO: 2195 - DNA, 32 bp, Plutella xylostella
caccgcgacgacacgttcatggtgcgcggcgg

SEQ ID NO: 2196 - DNA, 21 bp, Plutella xylostella
cagatcaaggagatggtggag

SEQ ID NO: 2197 - DNA, 23 bp, Plutella xylostella
cccgacgagaagatccgcatgaa

SEQ ID NO: 2198 - DNA, 29 bp, Plutella xylostella
cccgacgagaagatccgcatgaaccgcgt

SEQ ID NO: 2199 - DNA, 28 bp, Plutella xylostella
ccgacgagaagatccgcatgaaccgcgt

SEQ ID NO: 2200 - DNA, 26 bp, Plutella xylostella
cgcaaggagaccgtgtgcattgtgct

SEQ ID NO: 2201 - DNA, 23 bp, Plutella xylostella
gacgagaagatccgcatgaaccg

SEQ ID NO: 2202 - DNA, 26 bp, Plutella xylostella
gacgagaagatccgcatgaaccgcgt

SEQ ID NO: 2203 - DNA, 26 bp, Plutella xylostella
gcgcagatcaaggagatggtggagct

SEQ ID NO: 2204 - DNA, 21 bp, Plutella xylostella
ggcatgcgcgccgtcgagttc

SEQ ID NO: 2205 - DNA, 21 bp, Plutella xylostella
gtgcgcggcggcatgcgcgcc

SEQ ID NO: 2206 - DNA, 21 bp, Plutella xylostella
tcaaggagatggtggagctgc

SEQ ID NO: 2207 - DNA, 22 bp, Plutella xylostella
tgaagccgtacttcatggaggc

SEQ ID NO: 2208 - DNA, 35 bp, Plutella xylostella
tgccgcaagcagctggcgcagatcaaggagatggt

SEQ ID NO: 2209 - DNA, 23 bp, Plutella xylostella
tggaggcgtaccggcccatccac

SEQ ID NO: 2210 - DNA, 23 bp, Plutella xylostella
aaggaccactccgacgtgtccaa

SEQ ID NO: 2211 - DNA, 23 bp, Plutella xylostella
aaggacgtgcaggcgatgaaggc

SEQ ID NO: 2212 - DNA, 24 bp, Plutella xylostella
accaagttcgagaagaacttcatc

SEQ ID NO: 2213 - DNA, 26 bp, Plutella xylostella
accaagttcgagaagaacttcatcac

SEQ ID NO: 2214 - DNA, 29 bp, Plutella xylostella
accgccaggttcttcaagcaggacttcga

SEQ ID NO: 2215 - DNA, 29 bp, Plutella xylostella
accggcgatattctgcgcacgcccgtctc

SEQ ID NO: 2216 - DNA, 22 bp, Plutella xylostella
agcaggacttcgaggagaacgg

SEQ ID NO: 2217 - DNA, 29 bp, Plutella xylostella
atcacgcagatccccatcctgaccatgcc

SEQ ID NO: 2218 - DNA, 26 bp, Plutella xylostella
atcttgaccgacatgtcttcatacgc

SEQ ID NO: 2219 - DNA, 26 bp, Plutella xylostella
atgaccaggaaggaccactccgacgt

SEQ ID NO: 2220 - DNA, 23 bp, Plutella xylostella
atgcccaacgacgacatcaccca

SEQ ID NO: 2221 - DNA, 44 bp, Plutella xylostella
cagaagatccccatcttctccgccgccggtctgccccacaacga

SEQ ID NO: 2222 - DNA, 35 bp, Plutella xylostella
caggacttcgaggagaacggttccatggagaacgt

SEQ ID NO: 2223 - DNA, 23 bp, Plutella xylostella
ccaagttcgagaagaacttcatc

SEQ ID NO: 2224 - DNA, 35 bp, Plutella xylostella
cccatcaacccgtggtcccgtatctacccggagga

SEQ ID NO: 2225 - DNA, 41 bp, Plutella xylostella
cccgacttgaccgggtacatcactgagggacagatctacgt

SEQ ID NO: 2226 - DNA, 35 bp, Plutella xylostella
cccggacgacgtggtttcccaggttacatgtacac

SEQ ID NO: 2227 - DNA, 30 bp, Plutella xylostella
cctggacatccaggggcagcccatcaaccc

SEQ ID NO: 2228 - DNA, 38 bp, Plutella xylostella
cgacgtggtttcccaggttacatgtacacggatttggc

SEQ ID NO: 2229 - DNA, 23 bp, Plutella xylostella
cgtctcatgaagtccgccatcgg

SEQ ID NO: 2230 - DNA, 36 bp, Plutella xylostella
cgtctcatgaagtccgccatcggagagggcatgacc

SEQ ID NO: 2231 - DNA, 26 bp, Plutella xylostella
cgtggtcagaagatccccatcttctc

SEQ ID NO: 2232 - DNA, 29 bp, Plutella xylostella
cgtggtcagaagatccccatcttctccgc

SEQ ID NO: 2233 - DNA, 26 bp, Plutella xylostella
cgtggtttcccaggttacatgtacac

SEQ ID NO: 2234 - DNA, 59 bp, Plutella xylostella
cgtggtttcccaggttacatgtacacggatttggccacaatctacgagcgcgccgggcg

SEQ ID NO: 2235 - DNA, 27 bp, Plutella xylostella
ctacgagaaccgcacagtgttcgagtc

SEQ ID NO: 2236 - DNA, 23 bp, Plutella xylostella
ctgcgtatcttccccaaggagat

SEQ ID NO: 2237 - DNA, 23 bp, Plutella xylostella
ctgtacgcgtgctacgccatcgg

SEQ ID NO: 2238 - DNA, 23 bp, Plutella xylostella
ctgttcttgaacttggccaatga

SEQ ID NO: 2239 - DNA, 26 bp, Plutella xylostella
ctgttcttgaacttggccaatgaccc

SEQ ID NO: 2240 - DNA, 23 bp, Plutella xylostella
gacaacttcgccatcgtgttcgc

SEQ ID NO: 2241 - DNA, 26 bp, Plutella xylostella
gacaacttcgccatcgtgttcgccgc

SEQ ID NO: 2242 - DNA, 32 bp, Plutella xylostella
gacaacttcgccatcgtgttcgccgccatggg

SEQ ID NO: 2243 - DNA, 23 bp, Plutella xylostella
gaccgtcagctgcacaacaggca

SEQ ID NO: 2244 - DNA, 21 bp, Plutella xylostella
gacctgctctacctcgagttc

SEQ ID NO: 2245 - DNA, 23 bp, Plutella xylostella
gacgtgatgaactccatcgcccg

SEQ ID NO: 2246 - DNA, 26 bp, Plutella xylostella
gacgtgatgaactccatcgcccgtgg

SEQ ID NO: 2247 - DNA, 23 bp, Plutella xylostella
gagaacggttccatggagaacgt

SEQ ID NO: 2248 - DNA, 32 bp, Plutella xylostella
gaggagatgatccagactggtatctccgctat

SEQ ID NO: 2249 - DNA, 50 bp, Plutella xylostella
gaggagatgatccagactggtatctccgctatcgacgtgatgaactccat

SEQ ID NO: 2250 - DNA, 24 bp, Plutella xylostella
gaggaggcgctcacgcccgacgac

SEQ ID NO: 2251 - DNA, 26 bp, Plutella xylostella
gagttcttggcctaccagtgcgagaa

SEQ ID NO: 2252 - DNA, 35 bp, Plutella xylostella
gccaggttcttcaagcaggacttcgaggagaacgg

SEQ ID NO: 2253 - DNA, 23 bp, Plutella xylostella
gcccgtggtcagaagatccccat

SEQ ID NO: 2254 - DNA, 29 bp, Plutella xylostella
gcccgtggtcagaagatccccatcttctc

SEQ ID NO: 2255 - DNA, 35 bp, Plutella xylostella
gcccgtggtcagaagatccccatcttctccgccgc

SEQ ID NO: 2256 - DNA, 29 bp, Plutella xylostella
gccgagttcttggcctaccagtgcgagaa

SEQ ID NO: 2257 - DNA, 41 bp, Plutella xylostella
gccgagttcttggcctaccagtgcgagaaacacgtgttggt

SEQ ID NO: 2258 - DNA, 26 bp, Plutella xylostella
gccgcccgtgaggaggtgcccggacg

SEQ ID NO: 2259 - DNA, 47 bp, Plutella xylostella
gcctaccagtgcgagaaacacgtgttggtaatcttgaccgacatgtc

SEQ ID NO: 2260 - DNA, 22 bp, Plutella xylostella
ggcagatctacccgccggtgaa

SEQ ID NO: 2261 - DNA, 26 bp, Plutella xylostella
ggcgaggaggcgctcacgcccgacga

SEQ ID NO: 2262 - DNA, 23 bp, Plutella xylostella
ggtcagaagatccccatcttctc

SEQ ID NO: 2263 - DNA, 26 bp, Plutella xylostella
ggttacatgtacacggatttggccac

SEQ ID NO: 2264 - DNA, 26 bp, Plutella xylostella
gtggtgggcgaggaggcgctcacgcc

SEQ ID NO: 2265 - DNA, 21 bp, Plutella xylostella
gttcaccggcgatattctgcg

SEQ ID NO: 2266 - DNA, 24 bp, Plutella xylostella
gttcaccggcgatattctgcgcac

SEQ ID NO: 2267 - DNA, 26 bp, Plutella xylostella
taccagtgcgagaaacacgtgttggt

SEQ ID NO: 2268 - DNA, 35 bp, Plutella xylostella
tacgccatcggcaaggacgtgcaggcgatgaaggc

SEQ ID NO: 2269 - DNA, 23 bp, Plutella xylostella
tccatcacgcagatccccatcct

SEQ ID NO: 2270 - DNA, 23 bp, Plutella xylostella
tccggcaagcccatcgacaaggg

SEQ ID NO: 2271 - DNA, 23 bp, Plutella xylostella
tctacgagcgcgccgggcgagtc

SEQ ID NO: 2272 - DNA, 26 bp, Plutella xylostella
tctcgtctcatgaagtccgccatcgg

SEQ ID NO: 2273 - DNA, 49 bp, Plutella xylostella
tgactgctgccgagttcttggcctaccagtgcgagaaacacgtgttggt

SEQ ID NO: 2274 - DNA, 22 bp, Plutella xylostella
tgcacaacaggcagatctaccc

SEQ ID NO: 2275 - DNA, 22 bp, Plutella xylostella
tgcgtatcttccccaaggagat

SEQ ID NO: 2276 - DNA, 29 bp, Plutella xylostella
tgctacgccatcggcaaggacgtgcaggc

SEQ ID NO: 2277 - DNA, 44 bp, Plutella xylostella
tgctctacctcgagttcctcaccaagttcgagaagaacttcatc

SEQ ID NO: 2278 - DNA, 23 bp, Plutella xylostella
tgtctgttcttgaacttggccaa

SEQ ID NO: 2279 - DNA, 26 bp, Plutella xylostella
tgtctgttcttgaacttggccaatga

SEQ ID NO: 2280 - DNA, 22 bp, Plutella xylostella
tgttcttgaacttggccaatga

SEQ ID NO: 2281 - DNA, 23 bp, Plutella xylostella
ttcaacggctccggcaagcccat

SEQ ID NO: 2282 - DNA, 32 bp, Plutella xylostella
ttcaacggctccggcaagcccatcgacaaggg

SEQ ID NO: 2283 - DNA, 26 bp, Plutella xylostella
ttcgaggagaacggttccatggagaa

SEQ ID NO: 2284 - DNA, 29 bp, Plutella xylostella
ttcgaggagaacggttccatggagaacgt

SEQ ID NO: 2285 - DNA, 26 bp, Plutella xylostella
ttcttcaagcaggacttcgaggagaa

SEQ ID NO: 2286 - DNA, 29 bp, Plutella xylostella
ttcttcaagcaggacttcgaggagaacgg

SEQ ID NO: 2287 - DNA, 32 bp, Plutella xylostella
ttcttcaagcaggacttcgaggagaacggttc

SEQ ID NO: 2288 - DNA, 44 bp, Plutella xylostella
ttcttcaagcaggacttcgaggagaacggttccatggagaacgt

SEQ ID NO: 2289 - DNA, 23 bp, Plutella xylostella
ttcttgaacttggccaatgaccc

SEQ ID NO: 2290 - DNA, 23 bp, Plutella xylostella
ttcttggcctaccagtgcgagaa

SEQ ID NO: 2291 - DNA, 21 bp, Plutella xylostella
ctcgacatcgccacctgcaag

SEQ ID NO: 2292 - DNA, 21 bp, Plutella xylostella
gacggcaaggtccgcaccgac

SEQ ID NO: 2293 - DNA, 21 bp, Plutella xylostella
cccggctggattcatggatgt

SEQ ID NO: 2294 - DNA, 26 bp, Plutella xylostella
atcaaggtggacggcaaggtccgcac

SEQ ID NO: 2295 - DNA, 22 bp, Plutella xylostella
acaacgtgttcatcatcggcaa

SEQ ID NO: 2296 - DNA, 35 bp, Plutella xylostella
cgtggtttcccaggttacatgtacacggatttggc

SEQ ID NO: 2297 - DNA, 23 bp, Plutella xylostella
ggtttcccaggttacatgtacac

SEQ ID NO: 2298 - DNA, 29 bp, Plutella xylostella
gagttcctcaccaagttcgagaagaactt

SEQ ID NO: 2299 - DNA, 23 bp, Plutella xylostella
ctcatcaaggtggacggcaaggt

SEQ ID NO: 2300 - DNA, 28 bp, Plutella xylostella
tcggtgcggaccttgccgtccaccttga

SEQ ID NO: 2301 - DNA, 21 bp, Plutella xylostella
gacggcaaggtccgcaccgac

SEQ ID NO: 2302 - DNA, 23 bp, Plutella xylostella
gacggcaaggtccgcaccgaccc

SEQ ID NO: 2303 - DNA, 26 bp, Plutella xylostella
aaggtccgcaccgaccccacctaccc

SEQ ID NO: 2304 - DNA, 23 bp, Plutella xylostella
cgcttcaccatccaccgcatcac

SEQ ID NO: 2305 - DNA, 22 bp, Plutella xylostella
cgaggaggccaagtacaagctg

SEQ ID NO: 2306 - DNA, 26 bp, Plutella xylostella
gaggccaagtacaagctgtgcaaggt

SEQ ID NO: 2307 - DNA, 21 bp, Plutella xylostella
gccaagtacaagctgtgcaag

SEQ ID NO: 2308 - DNA, 27 bp, Plutella xylostella
cccgacccgctcatcaaggtcaacgac

SEQ ID NO: 2309 - DNA, 22 bp, Plutella xylostella
cgacatcgtccacatcaaggac

SEQ ID NO: 2310 - DNA, 30 bp, Plutella xylostella
ccgcacaagctgcgcgagtgcctgccgctc

SEQ ID NO: 2311 - DNA, 23 bp, Plutella xylostella
ttcgaccaggaggcggcggcggt

SEQ ID NO: 2312 - DNA, 21 bp, Plutella xylostella
caccaccgccgccgcctcctg

SEQ ID NO: 2313 - DNA, 28 bp, Plutella xylostella
tgcaggtcttcaacaactcgcccgacga

SEQ ID NO: 2314 - DNA, 23 bp, Plutella xylostella
ttcaacaactcgcccgacgagac

SEQ ID NO: 2315 - DNA, 27 bp, Plutella xylostella
catgcgcgccgtcgagttcaaggtggt

SEQ ID NO: 2316 - DNA, 23 bp, Plutella xylostella
gcattcttcttcctcatcaacgg

SEQ ID NO: 2317 - DNA, 23 bp, Plutella xylostella
atcaacggccccgagatcatgtc

SEQ ID NO: 2318 - DNA, 22 bp, Plutella xylostella
tgcgcaaggcgttcgaggaggc

SEQ ID NO: 2319 - DNA, 25 bp, Plutella xylostella
cctcaccaagttcgagaagaacttc

SEQ ID NO: 2320 - DNA, 23 bp, Plutella xylostella
gaggagatgatccagactggtat

SEQ ID NO: 2321 - DNA, 26 bp, Plutella xylostella
gaggagatgatccagactggtatctc

SEQ ID NO: 2322 - DNA, 32 bp, Plutella xylostella
atgaactccatcgcccgtggtcagaagatccc

SEQ ID NO: 2323 - DNA, 26 bp, Plutella xylostella
gtcagaagatccccatcttctccgcc

SEQ ID NO: 2324 - DNA, 23 bp, Plutella xylostella
cagaagatccccatcttctccgc

SEQ ID NO: 2325 - DNA, 24 bp, Plutella xylostella
cagaagatccccatcttctccgcc

SEQ ID NO: 2326 - DNA, 29 bp, Plutella xylostella
cagaagatccccatcttctccgccgccgg

SEQ ID NO: 2327 - DNA, 29 bp, Plutella xylostella
aagatccccatcttctccgccgccggtct

SEQ ID NO: 2328 - DNA, 26 bp, Plutella xylostella
cccatcttctccgccgccggtctgcc

SEQ ID NO: 2329 - DNA, 26 bp, Plutella xylostella
ggtctgccccacaacgagattgctgc

SEQ ID NO: 2330 - DNA, 29 bp, Plutella xylostella
ttcgccgccatgggagtcaacatggagac

SEQ ID NO: 2331 - DNA, 23 bp, Plutella xylostella
accgccaggttcttcaagcagga

SEQ ID NO: 2332 - DNA, 23 bp, Plutella xylostella
ctgttcttgaacttggccaatga

SEQ ID NO: 2333 - DNA, 21 bp, Plutella xylostella
ggttacatgtacacggatttg

SEQ ID NO: 2334 - DNA, 24 bp, Plutella xylostella
ggcaagcccatcgacaaggggccc

SEQ ID NO: 2335 - DNA, 34 bp, Plutella xylostella
atggggtgggtgatgtcgtcgttgggcatggtca

SEQ ID NO: 2336 - DNA, 29 bp, Plutella xylostella
accatgcccaacgacgacatcacccaccc

SEQ ID NO: 2337 - DNA, 22 bp, Plutella xylostella
tgcacaacaggcagatctaccc

SEQ ID NO: 2338 - DNA, 23 bp, Plutella xylostella
ccgtcgctatctcgtctcatgaa

SEQ ID NO: 2339 - DNA, 514 bp, Plutella xylostella
cgaggtgctgaagatcgtgaagcagcgcctcatcaaggtggacggcaaggtccgcaccgaccccacctacccggctggattcatggatgttgtgtcgattgaaaagaccaatgagctgttccgtctgatctacgatgtgaagggacgcttcaccatccaccgcatcactcccgaggaggccaagtacaagctgtgcaaggtgaagcgcgtggcgacgggccccaagaacgtgccgtacatcgtgacgcacaacggccgcacgctgcgctaccccgacccgctcatcaaggtcaacgactccatccagctcgacatcgccacctgcaagatcatggacatcatcaagttcgactcaggtaacctgtgcatgatcacgggagggcgtaacttggggcgagtgggcaccatcgtgtcccgcgagaggcaccccgggagcttcgacatcgtccacatcaaggacaccaccggacacaccttcgccaccaggttgaacaacgtgttcatcatcggcaag

SEQ ID NO: 2340 - DNA, 44 bp, Artificial Sequence
  synthetic oligo
gcgtaatacgactcactataggcgaggtgctgaagatcgtgaag

SEQ ID NO: 2341 - DNA, 22 bp, Artificial Sequence
  synthetic oligo
cttgccgatgatgaacacgttg

SEQ ID NO: 2342 - DNA, 22 bp, Artificial Sequence
  synthetic oligo
cgaggtgctgaagatcgtgaag

SEQ ID NO: 2343 - DNA, 44 bp, Artificial Sequence
  synthetic oligo
gcgtaatacgactcactataggcttgccgatgatgaacacgttg

SEQ ID NO: 2344 - DNA, 524 bp, Plutella xylostella
cagctacaagtattgggagaaccagctcattgactttttgtcagtatacaagaagaagggtcagacagcgggtgctggtcagaacatcttcaactgtgacttccgcaacccgcccccacacggcaaggtgtgcgacgtggacatccgcggctgggagccctgcattgatgagaaccacttctctttccacaagtcttcgccttgcatcttcttgaagctgaataagatctacggctggcgtccagagttctacaacgacacggctaacctgcctgaagccatgcccgtggacttgcagacccacattcgtaacattactgccttcaacagagactatgcgaacatggtgtgggtgtcgtgccacggcgagacgccggcggacaaggagaacatcgggccggtgcgctacctgccctacccgggcttccccgggtacttctacccgtacgagaacgccgaggggtatctgagcccgctggtcgccgtgcatttggagaggccgaggaccggcatagtgatcaaca

SEQ ID NO: 2345 - DNA, 47 bp, Artificial Sequence
  synthetic oligo
gcgtaatacgactcactataggcagctacaagtattgggagaaccag

SEQ ID NO: 2346 - DNA, 22 bp, Artificial Sequence
  synthetic oligo
tgttgatcactatgccggtcct

SEQ ID NO: 2347 - DNA, 25 bp, Artificial Sequence
  synthetic oligo
cagctacaagtattgggagaaccag

SEQ ID NO: 2348 - DNA, 44 bp, Artificial Sequence
  synthetic oligo
gcgtaatacgactcactataggtgttgatcactatgccggtcct

SEQ ID NO: 2349 - DNA, 672 bp, Plutella xylostella
accagcactctagtggacaacgtcgcgttcgggtcaccactgtcgcgcgcaattggggcgacgcagccgccaacttacaccacatatcggcgggcttcgaccaggaggcggcggcggtggtgatggcgcggctggtggtgtaccgcgcggagcaggaggacgggcccgacgtgctgcgctggctcgaccgcatgctcatacgcctgtgccagaagttcggcgagtacgcgaaggacgacccgaacagcttccgtctgtcggagaacttcagcctgtacccgcagttcatgtaccacctgcgccgctcgcagttcctgcaggtcttcaacaactcgcccgacgagaccaccttctacagacacatgctgatgcgcgaagacctgacccaatccctcatcatgatccagccgatcctctactcgtacagcttcggaggcgcgcccgaacccgtgctgttagacaccagctccatccagcccgaccgcatcctgctcatggacaccttcttccagatcctcatctaccatggagagacaatggcgcaatggcgcgctctccgctaccaagacatggctgagtacgagaacttcaagcagctgctgcgagcgcccgtggacgacgcgcaggagatcctgcagaccaggttccccgtgccgcggtacattgatacag

SEQ ID NO: 2350 - DNA, 46 bp, Artificial Sequence
  synthetic oligo
gcgtaatacgactcactataggaccagcactctagtggacaacgtc

SEQ ID NO: 2351 - DNA, 22 bp, Artificial Sequence
  synthetic oligo
ctgtatcaatgtaccgcggcac

SEQ ID NO: 2352 - DNA, 24 bp, Artificial Sequence
  synthetic oligo
accagcactctagtggacaacgtc

SEQ ID NO: 2353 - DNA, 44 bp, Artificial Sequence
  synthetic oligo
gcgtaatacgactcactataggctgtatcaatgtaccgcggcac

SEQ ID NO: 2354 - DNA, 669 bp, Plutella xylostella
gacgagaagatccgcatgaaccgcgtcgtccggaacaacctgcgagtgcgcctgtcagacattgtgtccatcgctccttgcccgtcagtgaagtacggcaagagagttcatattctgcccattgatgactctgttgagggtttgactggaaacctgttcgaagtctacctgaagccgtacttcatggaggcgtaccggcccatccaccgcgacgacacgttcatggtgcgcggcggcatgcgcgccgtcgagttcaaggtggtggagaccgacccctcgccctactgcatcgtggcccccgacacggtcattcattgtgagggagagccgattaaacgcgaggaagaagaggaggctctcaacgccgtcggctacgacgacatcggcgggtgccgcaagcagctggcgcagatcaaggagatggtggagctgccgctgcgccacccctcgctgttcaaggccatcggggtcaagccgccgcgggggatactgatgtacgggcccccggggacggggaagaccttgatcgctagggctgtcgctaatgagacgggcgcattcttcttcctcatcaacggccccgagatcatgtcgaaactcgccggtgaatccgagtcgaacctgcgcaaggcgttcgaggaggcggacaagaactctccggccatcatc

SEQ ID NO: 2355 - DNA, 44 bp, Artificial Sequence
  synthetic oligo
gcgtaatacgactcactatagggacgagaagatccgcatgaacc

SEQ ID NO: 2356 - DNA, 22 bp, Artificial Sequence
  synthetic oligo
gatgatggccggagagttcttg

SEQ ID NO: 2357 - DNA, 22 bp, Artificial Sequence
  synthetic oligo
gacgagaagatccgcatgaacc

SEQ ID NO: 2358 - DNA, 44 bp, Artificial Sequence
  synthetic oligo
gcgtaatacgactcactatagggatgatggccggagagttcttg

SEQ ID NO: 2359 - DNA, 741 bp, Plutella xylostella
ctgggtcgtattttcaacggctccggcaagcccatcgacaaggggcccccgatcctggccgaggagtacctggacatccaggggcagcccatcaacccgtggtcccgtatctacccggaggagatgatccagactggtatctccgctatcgacgtgatgaactccatcgcccgtggtcagaagatccccatcttctccgccgccggtctgccccacaacgagattgctgctcagatctgtaggcaggctggtcttgtcaaggtccccggaaaatccgtgttggacgaccacgaagacaacttcgccatcgtgttcgccgccatgggagtcaacatggagaccgccaggttcttcaagcaggacttcgaggagaacggttccatggagaacgtctgtctgttcttgaacttggccaatgacccgaccattgagaggattatcacgccgaggttggcgctgactgctgccgagttcttggcctaccagtgcgagaaacacgtgttggtaatcttgaccgacatgtcttcatacgcggaggctcttcgtgaagtgtcagccgcccgtgaggaggtgcccggacgacgtggtttcccaggttacatgtacacggatttggccacaatctacgagcgcgccgggcgagtcgagggccgcaacggctccatcacgcagatccccatcctgaccatgcccaacgacgacatcacccaccccatccccgacttgaccgggtacatcact

SEQ ID NO: 2360 - DNA, 45 bp, Artificial Sequence
  synthetic oligo
gcgtaatacgactcactataggctgggtcgtattttcaacggctc

SEQ ID NO: 2361 - DNA, 22 bp, Artificial Sequence
  synthetic oligo
agtgatgtacccggtcaagtcg

SEQ ID NO: 2362 - DNA, 23 bp, Artificial Sequence
  synthetic oligo
ctgggtcgtattttcaacggctc

SEQ ID NO: 2363 - DNA, 44 bp, Artificial Sequence
  synthetic oligo
gcgtaatacgactcactataggagtgatgtacccggtcaagtcg

SEQ ID NO: 2364 - DNA, 755 bp, Acheta domesticus
ggccccaagaagcatttgaagcgtttaaatgctcctaaagcatggatgttggacaaactcggaggagtattcgctcctcgccccagtactggcccccacaaattgcgtgaatgtttacctttggtgatttttcttcgcaatcggctcaagtatgctctgacgaactgtgaagtaacgaagattgttatgcagcgacttatcaaagttgacggcaaggtgcgaaccgatccgaattatcccgctggtttcatggatgttgtcaccattgagaagactggagagttcttcaggctggtgtatgatgtgaaaggccgtttcacaattcacagaattagtgcagaagaagccaagtacaagctctgcaaggtcaggagagttcaaactgggccaaaaggtattccattcttggtgacccatgatggccgtactatccgttatcctgacccagtcattaaagttaatgactcaatccaattggatattgccacttgtaaaatcatggaccacatcagatttgaatctggcaacctgtgtatgattactggtggacgtaacttgggtcgagtggggactgttgtgagtcgagaacgtcacccaggctcgtttgatattgttcatatcaaggatacccaaggacatacttttgccacaagattgaataatgtattcatcattggaaaagctacaaagccttacatttcattgccaaagggtaagggtgtgaaattgagtatcgccgaggagcgggacaagcg

SEQ ID NO: 2365 - protein, 251 aa, Acheta domesticus
GPKKHLKRLNAPKAWMLDKLGGVFAPRPSTGPHKLRECLPLVIFLRNRLKYALTNCEVTKIVMQRLIKVDGKVRTDPNYPAGFMDVVTIEKTGEFFRLVYDVKGRFTIHRISAEEAKYKLCKVRRVQTGPKGIPFLVTHDGRTIRYPDPVIKVNDSIQLDIATCKIMDHIRFESGNLCMITGGRNLGRVGTVVSRERHPGSFDIVHIKDTQGHTFATRLNNVFIIGKATKPYISLPKGKGVKLSIAEERDK

SEQ ID NO: 2366 - DNA, 396 bp, Acheta domesticus
gagtttctttagtaaagtattcggtgggaagaaagatggaaaggctccgaccactggtgaggccattcagaaactcagagaaacagaagaaatgttaatcaaaaagcaggaatttttagagaagaaaatcgaacaagaaatcaatgttgcaaagaaaaatggaacgaaaaataagcgagctgctattcaggctctgaaaaggaaaaagaggtatgaaaaacaattgcagcaaattgatggcaccttatccacaattgaaatgcaaagagaagctttggagggtgctaatactaatacagctgtattacaaacaatgaaatcagcagcagatgcccttaaagcagctcatcagcacatggatgtggacaaggtacatgacctgatggatgacattgc

SEQ ID NO: 2367 - protein, 131 aa, Acheta domesticus
SFFSKVFGGKKDGKAPTTGEAIQKLRETEEMLIKKQEFLEKKIEQEINVAKKNGTKNKRAAIQALKRKKRYEKQLQQIDGTLSTIEMQREALEGANTNTAVLQTMKSAADALKAAHQHMDVDKVHDLMDDI

SEQ ID NO: 2368 - DNA, 561 bp, Acheta domesticus
gagtcctagccgccttggttgcagtatgtttatgggtcttcttccagacactggatcctcgtattcccacctggcagttagattcttctatcattggcacatcacctggcctaggtttccggccaatgccagaagatagcaatgtagagtcaactctcatctggtaccgtggaacagatcgtgatgacttccgtcagtggacagacacccttgatgaatttcttgctgtgtacaagactcctggtctgacccctggtcgaggtcagaacatccacaactgtgactatgataagccgccaaagaaaggccaagtttgcaatgtggacatcaagaattggcatccctgcattcaagagaatcactacaactaccacaagagctctccatgcatattcatcaagctcaacaagatctacaattggatccctgaatactacaatgagagtacgaatttgcctgagcagatgccagaagacctgaagcagtacatccacaacctggagagtaacaactcgagggagatgaacacggtgtgggtgtcgtgcgagggagagaatccag

SEQ ID NO: 2369 - protein, 186 aa, Acheta domesticus
VLAALVAVCLWVFFQTLDPRIPTWQLDSSIIGTSPGLGFRPMPEDSNVESTLIWYRGTDRDDFRQWTDTLDEFLAVYKTPGLTPGRGQNIHNCDYDKPPKKGQVCNVDIKNWHPCIQENHYNYHKSSPCIFIKLNKIYNWIPEYYNESTNLPEQMPEDLKQYIHNLESNNSREMNTVWVSCEGENP

SEQ ID NO: 2370 - DNA, 1079 bp, Acheta domesticus
ggatgaactacagcttttccgaggagatacagttcttcttaaaggaaaaaggaggaaagaaactgtatgcatagtgttatcagatgatacatgtcctgatggaaaaataagaatgaatagagttgtacgcaacaatttacgtgttcgtttgtcagatgttgtatctgtacaaccttgtcctgatgttaagtatggaaaaaggatacatgtactaccaattgatgatacagttgaaggactaaccgggaatttgtttgaggtgtacttaaaaccgtactttctcgaagcataccgacccattcacaaagatgatgcgtttattgttcgtggtggtatgcgagcagtagaattcaaagtagtggaaacagatccttcaccatattgtattgttgctcctgatactgttattcactgtgaaggtgatccaataaaacgtgaagaggaagaagaagcattaaatgctgttggttatgatgacattgggggttgccgaaaacagctagcacagatcaaggaaatggtggaattgccattacggcaccccagtctctttaaggctattggtgttaagccaccgaggggaatactgctgtatggaccccctggaactggtaaaaccctcattgccagggctgtggctaatgaaactggtgcattcttctttttaataaatggtcctgaaattatgagcaagcttgctggtgaatctgaaagcaacttacgtaaggcatttgaagaagctgataagaatgctccggcaattatatttattgatgaactagatgcaattgcccctaaaagagaaaaaactcatggagaggtggaacgtcgcatagtttcacaactactaactttaatggatggtctgaagcaaagttcacatgttattgttatggctgccacaaatagacccaactctattgatggtgccttgcgccgctttggcagatttgatagggaaattgatattggtataccagatgccactggtcgccttgaaattcttcgtatccatactaagaatatgaagttagctgatgatgttgatttggaacagattgcagccgaatcccacggac

SEQ ID NO: 2371 - protein, 359 aa, Acheta domesticus
DELQLFRGDTVLLKGKRRKETVCIVLSDDTCPDGKIRMNRVVRNNLRVRLSDVVSVQPCPDVKYGKRIHVLPIDDTVEGLTGNLFEVYLKPYFLEAYRPIHKDDAFIVRGGMRAVEFKVVETDPSPYCIVAPDTVIHCEGDPIKREEEEEALNAVGYDDIGGCRKQLAQIKEMVELPLRHPSLFKAIGVKPPRGILLYGPPGTGKTLIARAVANETGAFFFLINGPEIMSKLAGESESNLRKAFEEADKNAPAIIFIDELDAIAPKREKTHGEVERRIVSQLLTLMDGLKQSSHVIVMAATNRPNSIDGALRRFGRFDREIDIGIPDATGRLEILRIHTKNMKLADDVDLEQIAAESHG

SEQ ID NO: 2372 - DNA, 740 bp, Acheta domesticus
gttcaccggcgatattctgcgcgtgcccgtgtccgaggacatgctgggccgcaccttcaacggcagcggcatccccatcgacggcggcccgcccatcgtcgcagagacctacctcgacgtccagggcatgccgattaatcctcaaacgcgcatctacccggaagaaatgatccagacggggatctcgaccatcgacgtgatgacgtccatcgcgcgagggcagaagatccccatcttctcgggcgcagggctgccacacaacgagatcgctgcgcagatctgccgacaggcggggctggtgcagcacaaggagaacaaggacgacttcgccatcgtgttcgcggcgatgggcgtcaacatggagacggcgcgcttcttcaagcgcgagttcgcgcagacgggcgcgtgcaacgtggtgctgttcctcaacctggccaacgaccccaccatcgagcgcatcatcaccccgcgcctcgcgctcaccgtggccgagttcctggcctaccagtgcaacaagcacgtgctcgtcatcatgaccgacatgacctcctacgcggaggcgctgcgcgaggtgagcgcggcgcgcgaggaggttcctgggcgaagaggcttcccaggctacatgtacaccgatctctccaccatctacgagcgcgctggccgtgtgcaaggccgccccggctccatcactcagatccccatcctgacgatgcccaacgacgacatcacccatcctattc

SEQ ID NO: 2373 - protein, 246 aa, Acheta domesticus
FTGDILRVPVSEDMLGRTFNGSGIPIDGGPPIVAETYLDVQGMPINPQTRIYPEEMIQTGISTIDVMTSIARGQKIPIFSGAGLPHNEIAAQICRQAGLVQHKENKDDFAIVFAAMGVNMETARFFKREFAQTGACNVVLFLNLANDPTIERIITPRLALTVAEFLAYQCNKHVLVIMTDMTSYAEALREVSAAREEVPGRRGFPGYMYTDLSTIYERAGRVQGRPGSITQIPILTMPNDDITHPI

SEQ ID NO: 2374 - DNA, 23 bp, Artificial Sequence
  synthetic oligo
ggccccaagaagcatttgaagcg

SEQ ID NO: 2375 - DNA, 23 bp, Artificial Sequence
  synthetic oligo
  misc_feature (18)..(18): n is a, c, g, or t
cgcttgtcccgctcctcngcrat

SEQ ID NO: 2376 - DNA, 27 bp, Artificial Sequence
  synthetic oligo
gagtttctttagtaaagtattcggtgg

SEQ ID NO: 2377 - DNA, 26 bp, Artificial Sequence
  synthetic oligo
gcaatgtcatccatcakrtcrtgtac

SEQ ID NO: 2378 - DNA, 22 bp, Artificial Sequence
  synthetic oligo
gagtcctagccgcvytsgtkgc

SEQ ID NO: 2379 - DNA, 26 bp, Artificial Sequence
  synthetic oligo
ctggattctctccctcgcamgahacc

SEQ ID NO: 2380 - DNA, 24 bp, Artificial Sequence
  synthetic oligo
ggatgaactacagctbttccghgg

SEQ ID NO: 2381 - DNA, 23 bp, Artificial Sequence
  synthetic oligo
gtccgtgggaytcrgchgcaatc

SEQ ID NO: 2382 - DNA, 21 bp, Artificial Sequence
  synthetic oligo
gttcaccggcgayatyctgcg

SEQ ID NO: 2383 - DNA, 24 bp, Artificial Sequence
  synthetic oligo
ggaataggatgggtratrtcgtcg

SEQ ID NO: 2384 - DNA, 21 bp, Acheta domesticus
aaagcatggatgttggacaaa

SEQ ID NO: 2385 - DNA, 23 bp, Acheta domesticus
aaagcatggatgttggacaaact

SEQ ID NO: 2386 - DNA, 68 bp, Acheta domesticus
aaaggtattccattcttggtgacccatgatggccgtactatccgttatcctgacccagtcattaaagt

SEQ ID NO: 2387 - DNA, 47 bp, Acheta domesticus
aactgtgaagtaacgaagattgttatgcagcgacttatcaaagttga

SEQ ID NO: 2388 - DNA, 23 bp, Acheta domesticus
aagaagcatttgaagcgtttaaa

SEQ ID NO: 2389 - DNA, 26 bp, Acheta domesticus
aagggtaagggtgtgaaattgagtat

SEQ ID NO: 2390 - DNA, 23 bp, Acheta domesticus
aatgtattcatcattggaaaagc

SEQ ID NO: 2391 - DNA, 22 bp, Acheta domesticus
agaagcatttgaagcgtttaaa

SEQ ID NO: 2392 - DNA, 25 bp, Acheta domesticus
agaagcatttgaagcgtttaaatgc

SEQ ID NO: 2393 - DNA, 23 bp, Acheta domesticus
agtactggcccccacaaattgcg

SEQ ID NO: 2394 - DNA, 26 bp, Acheta domesticus
agtgcagaagaagccaagtacaagct

SEQ ID NO: 2395 - DNA, 22 bp, Acheta domesticus
atcgccgaggagcgggacaagc

SEQ ID NO: 2396 - DNA, 50 bp, Acheta domesticus
caaggacatacttttgccacaagattgaataatgtattcatcattggaaa

SEQ ID NO: 2397 - DNA, 22 bp, Acheta domesticus
cagaagaagccaagtacaagct

SEQ ID NO: 2398 - DNA, 23 bp, Acheta domesticus
catgatggccgtactatccgtta

SEQ ID NO: 2399 - DNA, 32 bp, Acheta domesticus
catgatggccgtactatccgttatcctgaccc

SEQ ID NO: 2400 - DNA, 23 bp, Acheta domesticus
catttgaagcgtttaaatgctcc

SEQ ID NO: 2401 - DNA, 21 bp, Acheta domesticus
cctaaagcatggatgttggac

SEQ ID NO: 2402 - DNA, 23 bp, Acheta domesticus
cctaaagcatggatgttggacaa

SEQ ID NO: 2403 - DNA, 24 bp, Acheta domesticus
cctaaagcatggatgttggacaaa

SEQ ID NO: 2404 - DNA, 26 bp, Acheta domesticus
cctaaagcatggatgttggacaaact

SEQ ID NO: 2405 - DNA, 23 bp, Acheta domesticus
cgtactatccgttatcctgaccc

SEQ ID NO: 2406 - DNA, 38 bp, Acheta domesticus
gaatgtttacctttggtgatttttcttcgcaatcggct

SEQ ID NO: 2407 - DNA, 23 bp, Acheta domesticus
gcagaagaagccaagtacaagct

SEQ ID NO: 2408 - DNA, 23 bp, Acheta domesticus
gcatggatgttggacaaactcgg

SEQ ID NO: 2409 - DNA, 23 bp, Acheta domesticus
gctggtttcatggatgttgtcac

SEQ ID NO: 2410 - DNA, 28 bp, Acheta domesticus
ggccccaagaagcatttgaagcgtttaa

SEQ ID NO: 2411 - DNA, 23 bp, Acheta domesticus
ggtttcatggatgttgtcaccat

SEQ ID NO: 2412 - DNA, 35 bp, Acheta domesticus
tatgatgtgaaaggccgtttcacaattcacagaat

SEQ ID NO: 2413 - DNA, 21 bp, Acheta domesticus
tcattgccaaagggtaagggt

SEQ ID NO: 2414 - DNA, 49 bp, Acheta domesticus
tggatattgccacttgtaaaatcatggaccacatcagatttgaatctgg

SEQ ID NO: 2415 - DNA, 35 bp, Acheta domesticus
ttaaatgctcctaaagcatggatgttggacaaact

SEQ ID NO: 2416 - DNA, 26 bp, Acheta domesticus
tttgaatctggcaacctgtgtatgat

SEQ ID NO: 2417 - DNA, 26 bp, Acheta domesticus
tttgatattgttcatatcaaggatac

SEQ ID NO: 2418 - DNA, 21 bp, Acheta domesticus
aagaaaatcgaacaagaaatc

SEQ ID NO: 2419 - DNA, 23 bp, Acheta domesticus
cagcacatggatgtggacaaggt

SEQ ID NO: 2420 - DNA, 27 bp, Acheta domesticus
gagtttctttagtaaagtattcggtgg

SEQ ID NO: 2421 - DNA, 21 bp, Acheta domesticus
cactacaactaccacaagagc

SEQ ID NO: 2422 - DNA, 22 bp, Acheta domesticus
cagaacatccacaactgtgact

SEQ ID NO: 2423 - DNA, 21 bp, Acheta domesticus
ggtgtgggtgtcgtgcgaggg

SEQ ID NO: 2424 - DNA, 23 bp, Acheta domesticus
tggatccctgaatactacaatga

SEQ ID NO: 2425 - DNA, 22 bp, Acheta domesticus
gagcagtagaattcaaagtagt

SEQ ID NO: 2426 - DNA, 21 bp, Acheta domesticus
gcaattatatttattgatgaa

SEQ ID NO: 2427 - DNA, 21 bp, Acheta domesticus
tcaccatattgtattgttgct

SEQ ID NO: 2428 - DNA, 21 bp, Acheta domesticus
ttgtcctgatgttaagtatgg

SEQ ID NO: 2429 - DNA, 29 bp, Acheta domesticus
acgatgcccaacgacgacatcacccatcc

SEQ ID NO: 2430 - DNA, 23 bp, Acheta domesticus
atgcccaacgacgacatcaccca

SEQ ID NO: 2431 - DNA, 30 bp, Acheta domesticus
atgcccaacgacgacatcacccatcctatt

SEQ ID NO: 2432 - DNA, 22 bp, Acheta domesticus
cagaagatccccatcttctcgg

SEQ ID NO: 2433 - DNA, 24 bp, Acheta domesticus
cggctccatcactcagatccccat

SEQ ID NO: 2434 - DNA, 21 bp, Acheta domesticus
gccaacgaccccaccatcgag

SEQ ID NO: 2435 - DNA, 24 bp, Acheta domesticus
gcccgtgtccgaggacatgctggg

SEQ ID NO: 2436 - DNA, 22 bp, Acheta domesticus
ggcagaagatccccatcttctc

SEQ ID NO: 2437 - DNA, 21 bp, Acheta domesticus
gttcaccggcgatattctgcg

SEQ ID NO: 2438 - DNA, 22 bp, Acheta domesticus
gttcaccggcgatattctgcgc

SEQ ID NO: 2439 - DNA, 22 bp, Acheta domesticus
ataaatggtcctgaaattatga

SEQ ID NO: 2440 - DNA, 23 bp, Acheta domesticus
gtcaacatggagacggcgcgctt

SEQ ID NO: 2441 - DNA, 21 bp, Acheta domesticus
cccgctggtttcatggatgtt

SEQ ID NO: 2442 - DNA, 24 bp, Acheta domesticus
gacaacatccatgaaaccagcggg

SEQ ID NO: 2443 - DNA, 22 bp, Acheta domesticus
ttcatggatgttgtcaccattg

SEQ ID NO: 2444 - DNA, 23 bp, Acheta domesticus
gaagaagccaagtacaagctctg

SEQ ID NO: 2445 - DNA, 22 bp, Acheta domesticus
aagaagccaagtacaagctctg

SEQ ID NO: 2446 - DNA, 23 bp, Acheta domesticus
gccaagtacaagctctgcaaggt

SEQ ID NO: 2447 - DNA, 25 bp, Acheta domesticus
gccaagtacaagctctgcaaggtca

SEQ ID NO: 2448 - DNA, 21 bp, Acheta domesticus
agtacaagctctgcaaggtca

SEQ ID NO: 2449 - DNA, 27 bp, Acheta domesticus
tatggaccccctggaactggtaaaacc

SEQ ID NO: 2450 - DNA, 28 bp, Acheta domesticus
tgcccgtgtccgaggacatgctgggccg

SEQ ID NO: 2451 - DNA, 29 bp, Acheta domesticus
tgcccgtgtccgaggacatgctgggccgc

SEQ ID NO: 2452 - DNA, 26 bp, Acheta domesticus
cgtgtccgaggacatgctgggccgca

SEQ ID NO: 2453 - DNA, 23 bp, Acheta domesticus
atgggcgtcaacatggagacggc

SEQ ID NO: 2454 - DNA, 21 bp, Acheta domesticus
tggagacggcgcgcttcttca

SEQ ID NO: 2455 - DNA, 26 bp, Acheta domesticus
ttcctcaacctggccaacgaccccac

SEQ ID NO: 2456 - DNA, 32 bp, Acheta domesticus
accatcgagcgcatcatcaccccgcgcctcgc

SEQ ID NO: 2457 - DNA, 23 bp, Acheta domesticus
tccaccatctacgagcgcgctgg

SEQ ID NO: 2458 - DNA, 26 bp, Acheta domesticus
ctgacgatgcccaacgacgacatcac

SEQ ID NO: 2459 - DNA, 23 bp, Acheta domesticus
atgcccaacgacgacatcaccca

SEQ ID NO: 2460 - DNA, 23 bp, Acheta domesticus
tgggtgatgtcgtcgttgggcat

SEQ ID NO: 2461 - DNA, 583 bp, Acheta domesticus
gctcctaaagcatggatgttggacaaactcggaggagtattcgctcctcgccccagtactggcccccacaaattgcgtgaatgtttacctttggtgatttttcttcgcaatcggctcaagtatgctctgacgaactgtgaagtaacgaagattgttatgcagcgacttatcaaagttgacggcaaggtgcgaaccgatccgaattatcccgctggtttcatggatgttgtcaccattgagaagactggagagttcttcaggctggtgtatgatgtgaaaggccgtttcacaattcacagaattagtgcagaagaagccaagtacaagctctgcaaggtcaggagagttcaaactgggccaaaaggtattccattcttggtgacccatgatggccgtactatccgttatcctgacccagtcattaaagttaatgactcaatccaattggatattgccacttgtaaaatcatggaccacatcagatttgaatctggcaacctgtgtatgattactggtggacgtaacttgggtcgagtggggactgttgtgagtcgagaacgtcacccaggctcgtttgatattg

SEQ ID NO: 2462 - DNA, 44 bp, Artificial Sequence
  synthetic oligo
gcgtaatacgactcactatagggctcctaaagcatggatgttgg

SEQ ID NO: 2463 - DNA, 22 bp, Artificial Sequence
  synthetic oligo
caatatcaaacgagcctgggtg

SEQ ID NO: 2464 - DNA, 22 bp, Artificial Sequence
  synthetic oligo
gctcctaaagcatggatgttgg

SEQ ID NO: 2465 - DNA, 44 bp, Artificial Sequence
  synthetic oligo
gcgtaatacgactcactataggcaatatcaaacgagcctgggtg

SEQ ID NO: 2466 - DNA, 335 bp, Acheta domesticus
gaagaaagatggaaaggctccgaccactggtgaggccattcagaaactcagagaaacagaagaaatgttaatcaaaaagcaggaatttttagagaagaaaatcgaacaagaaatcaatgttgcaaagaaaaatggaacgaaaaataagcgagctgctattcaggctctgaaaaggaaaaagaggtatgaaaaacaattgcagcaaattgatggcaccttatccacaattgaaatgcaaagagaagctttggagggtgctaatactaatacagctgtattacaaacaatgaaatcagcagcagatgcccttaaagcagctcatcagcacatggatg

SEQ ID NO: 2467 - DNA, 46 bp, Artificial Sequence
  synthetic oligo
gcgtaatacgactcactatagggaagaaagatggaaaggctccgac

SEQ ID NO: 2468 - DNA, 22 bp, Artificial Sequence
  synthetic oligo
catccatgtgctgatgagctgc

SEQ ID NO: 2469 - DNA, 24 bp, Artificial Sequence
  synthetic oligo
gaagaaagatggaaaggctccgac

SEQ ID NO: 2470 - DNA, 44 bp, Artificial Sequence
  synthetic oligo
gcgtaatacgactcactataggcatccatgtgctgatgagctgc

SEQ ID NO: 2471 - DNA, 495 bp, Acheta domesticus
gtcttcttccagacactggatcctcgtattcccacctggcagttagattcttctatcattggcacatcacctggcctaggtttccggccaatgccagaagatagcaatgtagagtcaactctcatctggtaccgtggaacagatcgtgatgacttccgtcagtggacagacacccttgatgaatttcttgctgtgtacaagactcctggtctgacccctggtcgaggtcagaacatccacaactgtgactatgataagccgccaaagaaaggccaagtttgcaatgtggacatcaagaattggcatccctgcattcaagagaatcactacaactaccacaagagctctccatgcatattcatcaagctcaacaagatctacaattggatccctgaatactacaatgagagtacgaatttgcctgagcagatgccagaagacctgaagcagtacatccacaacctggagagtaacaactcgagggagatgaacacg

SEQ ID NO: 2472 - DNA, 47 bp, Artificial Sequence
  synthetic oligo
gcgtaatacgactcactatagggtcttcttccagacactggatcctc

SEQ ID NO: 2473 - DNA, 22 bp, Artificial Sequence
  synthetic oligo
cgtgttcatctccctcgagttg

SEQ ID NO: 2474 - DNA, 25 bp, Artificial Sequence
  synthetic oligo
gtcttcttccagacactggatcctc

SEQ ID NO: 2475 - DNA, 44 bp, Artificial Sequence
  synthetic oligo
gcgtaatacgactcactataggcgtgttcatctccctcgagttg

SEQ ID NO: 2476 - DNA, 776 bp, Acheta domesticus
gttgaaggactaaccgggaatttgtttgaggtgtacttaaaaccgtactttctcgaagcataccgacccattcacaaagatgatgcgtttattgttcgtggtggtatgcgagcagtagaattcaaagtagtggaaacagatccttcaccatattgtattgttgctcctgatactgttattcactgtgaaggtgatccaataaaacgtgaagaggaagaagaagcattaaatgctgttggttatgatgacattgggggttgccgaaaacagctagcacagatcaaggaaatggtggaattgccattacggcaccccagtctctttaaggctattggtgttaagccaccgaggggaatactgctgtatggaccccctggaactggtaaaaccctcattgccagggctgtggctaatgaaactggtgcattcttctttttaataaatggtcctgaaattatgagcaagcttgctggtgaatctgaaagcaacttacgtaaggcatttgaagaagctgataagaatgctccggcaattatatttattgatgaactagatgcaattgcccctaaaagagaaaaaactcatggagaggtggaacgtcgcatagtttcacaactactaactttaatggatggtctgaagcaaagttcacatgttattgttatggctgccacaaatagacccaactctattgatggtgccttgcgccgctttggcagatttgatagggaaattgatattggtataccagatgccactggtcgccttgaaattct

SEQ ID NO: 2477 - DNA, 46 bp, Artificial Sequence
  synthetic oligo
gcgtaatacgactcactatagggttgaaggactaaccgggaatttg

SEQ ID NO: 2478 - DNA, 22 bp, Artificial Sequence
  synthetic oligo
agaatttcaaggcgaccagtgg

SEQ ID NO: 2479 - DNA, 24 bp, Artificial Sequence
  synthetic oligo
gttgaaggactaaccgggaatttg

SEQ ID NO: 2480 - DNA, 44 bp, Artificial Sequence
  synthetic oligo
gcgtaatacgactcactataggagaatttcaaggcgaccagtgg

SEQ ID NO: 2481 - DNA, 469 bp, Acheta domesticus
acccggaagaaatgatccagacggggatctcgaccatcgacgtgatgacgtccatcgcgcgagggcagaagatccccatcttctcgggcgcagggctgccacacaacgagatcgctgcgcagatctgccgacaggcggggctggtgcagcacaaggagaacaaggacgacttcgccatcgtgttcgcggcgatgggcgtcaacatggagacggcgcgcttcttcaagcgcgagttcgcgcagacgggcgcgtgcaacgtggtgctgttcctcaacctggccaacgaccccaccatcgagcgcatcatcaccccgcgcctcgcgctcaccgtggccgagttcctggcctaccagtgcaacaagcacgtgctcgtcatcatgaccgacatgacctcctacgcggaggcgctgcgcgaggtgagcgcggcgcgcgaggaggttcctgggcgaagaggcttcccaggctacat

SEQ ID NO: 2482 - DNA, 44 bp, Artificial Sequence
  synthetic oligo
gcgtaatacgactcactataggacccggaagaaatgatccagac

SEQ ID NO: 2483 - DNA, 22 bp, Artificial Sequence
  synthetic oligo
atgtagcctgggaagcctcttc

SEQ ID NO: 2484 - DNA, 22 bp, Artificial Sequence
  synthetic oligo
acccggaagaaatgatccagac

SEQ ID NO: 2485 - DNA, 44 bp, Artificial Sequence
  synthetic oligo
gcgtaatacgactcactataggatgtagcctgggaagcctcttc

SEQ ID NO: 2486 - DNA, 3431 bp, Leptinotarsa decemlineata
gggagcagacgatcggttggttaaaatctgggactatcaaaacaaaacgtgtgtccaaaccttggaaggacacgcccaaaacgtaaccgcggtttgtttccaccctgaactacctgtggctctcacaggcagcgaagatggtaccgttagagtttggcatacgaatacacacagattagagaattgtttgaattatgggttcgagagagtgtggaccatttgttgcttgaagggttcgaataatgtttctctggggtatgacgagggcagtatattagtgaaagttggaagagaagaaccggcagttagtatggatgccagtggcggtaaaataatttgggcaaggcactcggaattacaacaagctaatttgaaggcgctgccagaaggtggagaaataagagatggggagcgtttacctgtctctgtaaaagatatgggagcatgtgaaatataccctcaaacaatccaacataatccgaatggaagattcgttgtagtatgcggagacggcgaatatatcatttacacagcgatggctctacggaacaaggcttttggaagcgctcaagagtttgtctgggctcaggactccagcgagtatgccattcgcgagtctggttccacaattcggatattcaaaaacttcaaagaaaggaagaacttcaagtcggatttcagcgcggaaggaatctacgggggttttctcttggggattaaatcggtgtccggtttaacgttttacgattgggaaactttggacttggtgagacggattgaaatacaaccgagggcggtttattggtctgacagtggaaaattagtctgtctcgcaacggaggacagctacttcatcctttcttatgattcggagcaagttcagaaggccagggagaacaatcaagtcgcagaggatggcgtagaggccgctttcgatgtgttgggggaaatgaacgagtctgtccgaacccagctttcttgtacaaagtggtgatatcccgcgggatcagaagcaacctcatggaaatgatgaggtaaggtttcatactcttgcctcttcttacggctttctgtgtcttcactgtaagtttctatgatttgagccaccaatatatatgctctggtgtgctgagttatgtttatctggtcacgcttagtgggtaaaattatgcttattttagcataaactttaatgagattaggttttgtatcacaccgatctttagttgtttagtaagatgacagaaattcttggtaaaacactctaaatcgtcttctttagtgaagttttccttagagtagcataaattttggcttttttcttgatggttgaataaggtggcacttgttggtatgagactttattgagagtcatattaagctgatccacgcgtttacgccccgccctgccactcatcgcagtactgttgtaattcattaagcattctgccgacatggaagccatcacagacggcatgatgaacctgaatcgccagcggcatcagcaccttgtcgccttgcgtataatatttgcccatggtgaaaacgggggcgaagaagttgtccatattggccacgtttaaatcaaaactggtgaaactcacccagggattggctgagacgaaaaacatattctcaataaaccctttagggaaataggccaggttttcaccgtaacacgccacatcttgcgaatatatgtgtagaaactgccggaaatcgtcgtggtattcactccagagcgatgaaaacgtttcagtttgctcatggaaaacggtgtaacaagggtgaacactatcccatatcaccagctcaccgtctttcattgccatacggaattccggatgagcattcatcaggcgggcaagaatgtgaataaaggccggataaaacttgtgcttatttttctttacggtctttaaaaaggccgtaatatccagctgaacggtctggttataggtacattgagcaactgactgaaatgcctcaaaatgttctttacgatgccattgggatatatcaacggtggtatatccagtgatttttttctccattttagcttccttagctcctgaaaatctcgccggatcagcttagcgttcattgaatttgatggccataggggtttagatgcaactgtttctttgaacattgtagaaatatataaagattttacattagcctactcttgaaagtcaaattgtcgaatttgattatattatactctagaggtgatattagttaatgagtttatactcggttatttacagcttattcatataccagttaacgtgtctcatatattctaacttcttagcatttaacgtgtttgcaggtcagcttgacactgaacataacagcatcactagtgcggccgcctgcaggtcgaccatatggtcgacctgcaggcggccgcactagtgatataccactttgtacaagaaagctggtcgaattcgccctttcggacagactcgttcatttcccccaacacatcgaaagcggcctctacgccatcctctgcgacttgattgttctccctggccttctgaacttgctccgaatcataagaaaggatgaagtagctgtcctccgttgcgagacagactaattttccactgtcagaccaataaaccgccctcggttgtatttcaatccgtctcaccaagtccaaagtttcccaatcgtaaaacgttaaaccggacaccgatttaatccccaagagaaaacccccgtagattccttccgcgctgaaatccgacttgaagttcttcctttctttgaagtttttgaatatccgaattgtggaaccagactcgcgaatggcatactcgctggagtcctgagcccagacaaactcttgagcgcttccaaaagccttgttccgtagagccatcgctgtgtaaatgatatattcgccgtctccgcatactacaacgaatcttccattcggattatgttggattgtttgagggtatatttcacatgctcccatatcttttacagagacaggtaaacgctccccatctcttatttctccaccttctggcagcgccttcaaattagcttgttgtaattccgagtgccttgcccaaattattttaccgccactggcatccatactaactgccggttcttctcttccaactttcactaatatactgccctcgtcataccccagagaaacattattcgaacccttcaagcaacaaatggtccacactctctcgaacccataattcaaacaattctctaatctgtgtgtattcgtatgccaaactctaacggtaccatcttcgctgcctgtgagagccacaggtagttcagggtggaaacaaaccgcggttacgttttgggcgtgtccttccaaggtttggacacacgttttgttttgatagtcccagattttaaccaaccgatcgtctgctccc

SEQ ID NO: 2487 - DNA, 300 bp, Leptinotarsa decemlineata
ccatggcctgtccaccaaggcaaatgcgcccttagatcgaccgggacagctttatcgatagccattgggttgttggagtgcacatacgccaatactggtgccagggtcatgctattcgttggaggaccttgctctcaaggccctggtcaagtcttgaatgatgatctgaagcaacctatcagatctcaccacgacatccaaaaagacaatgccaaatacatgaagaaagcaatcaagcactatgataatttagcgatgagagcagcaacgaatggccactgcgttgacatatattcatgc

SEQ ID NO: 2488 - DNA, 300 bp, Phaedon cochleariae
ccttggcccgtacatcagggcaaaagacctcttagatccacaggcgcagcattgtccatcgctgtcggcctcttagaatgcacctatccgaatacgggtggcagaatcatgatattcttaggaggaccatgctctcagggtcccggccaggtgttgaacgacgatttgaagcagcccatcaggtcccatcatgacatacacaaagacaatgccaagtacatgaagaaggctatcaaacattacgatcacttggcaatgcgagctgccaccaacagccattgcatcgacatttactcctgc

SEQ ID NO: 2489 - DNA, 600 bp, Artificial
  synthetic oligo
ccatggcctgtccaccaaggcaaatgcgcccttagatcgaccgggacagctttatcgatagccattgggttgttggagtgcacatacgccaatactggtgccagggtcatgctattcgttggaggaccttgctctcaaggccctggtcaagtcttgaatgatgatctgaagcaacctatcagatctcaccacgacatccaaaaagacaatgccaaatacatgaagaaagcaatcaagcactatgataatttagcgatgagagcagcaacgaatggccactgcgttgacatatattcatgcccttggcccgtacatcagggcaaaagacctcttagatccacaggcgcagcattgtccatcgctgtcggcctcttagaatgcacctatccgaatacgggtggcagaatcatgatattcttaggaggaccatgctctcagggtcccggccaggtgttgaacgacgatttgaagcagcccatcaggtcccatcatgacatacacaaagacaatgccaagtacatgaagaaggctatcaaacattacgatcacttggcaatgcgagctgccaccaacagccattgcatcgacatttactcctgc

SEQ ID NO: 2490 - DNA, 600 bp, Artificial
  synthetic oligo
ccatggcctgtccaccaaggcaaatgcgcccttagatcgaccgggacagctttatcgatagccattgggttgttggagtgcacatacgccaatactggtgccagggtcatgctattcgttggaggaccttgctctcaaggccctggtcaagtcttgaatgatgatctgaagcaacctatcagatctcaccacgacatccaaaaagacaatgccaaatacatgaagaaagcaatcaagcactatgataatttagcgatgagagcagcaacgaatggccactgcgttgacatatattcatgctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaagaaggacg

SEQ ID NO: 2491 - DNA, 600 bp, Artificial
  synthetic oligo
agctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagcccttggcccgtacatcagggcaaaagacctcttagatccacaggcgcagcattgtccatcgctgtcggcctcttagaatgcacctatccgaatacgggtggcagaatcatgatattcttaggaggaccatgctctcagggtcccggccaggtgttgaacgacgatttgaagcagcccatcaggtcccatcatgacatacacaaagacaatgccaagtacatgaagaaggctatcaaacattacgatcacttggcaatgcgagctgccaccaacagccattgcatcgacatttactcctgc

SEQ ID NO: 2492 - DNA, 600 bp, Artificial
  synthetic oligo
agctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaagaaggacg

SEQ ID NO: 2493 - DNA, 2858 bp, Leptinotarsa decemlineata
gacagtgacgtgcctatgtggagtttgatatgtgtacagcaggaaaatgatcctcagctaacatattaagcctcagtagttagtgtcttcaaagtttatgactcctgtttcgctgcgcctaaagaccaactatcctagatacttttctaccttgattatcactgaaaatggctacatacgaagagtatatccagcaaaacgaagacagagacgggatacggttcacatggaacgtttggccgtccagcagaatagaagccacccgtttggtggtgcccttggcctgtctttaccaacccctgaaagaacgtcccgatcttccaccaattcagtacgatccagtgctgtgcactagaaacaattgtcgtgcaatactgaacccactctgccaagtagattatcgtgccaagctttgggtgtgcaacttctgctttcagaggaacccgtttccccctcaatatgccgccatttccgagcaacaccaaccagctgagcttatgccaatgttttccaccatagagtacactattacaagagcacagtgtttacccccgatatatctctatgttgtcgacacttgcatggatgaggaagaattgggttcactcaaggactccttgcaaatgtctttgagcttgttgcccccgaatgccttgatagggttgattacctttgggaagatggtccaagtgcacgaactaggtaccgagggctgcagcaaatcttacgttttccgagggacgaaagacctcacagctaagcaagttcaagagatgttggaagtgggcagagccgcagtaagtgctcaacctgctcctcaacaaccaggacaacccatgaggcctggagcactccagcaagctcctacgccaccaggaagcaggttccttcaacccatctcgaaatgcgacatgaacctcactgatcttattggagagttgcaaagagacccatggcctgtccaccaaggcaaatgcgcccttagatcgaccgggacagctttatcgatagccattgggttgttggagtgcacatacgccaatactggtgccagggtcatgctattcgttggaggaccttgctctcaaggccctggtcaagtcttgaatgatgatctgaagcaacctatcagatctcaccacgacatccaaaaagacaatgccaaatacatgaagaaagcaatcaagcactatgataatttagcgatgagagcagcaacgaatggccactgcgttgacatatattcatgcgctttggatcagacaggattgatggagatgaaacagtgttgtaattcaacagggggacatatggtcatgggcgactcgttcaattcttccctgttcaagcaaacgttccagcgcatattttcgaaagatcagaaaaacgagctgaagatggcatttaatggtactctggaggtcaagtgttccagggagttgaaaattcaaggcggtattggatcttgtgtttcgttgaatgtgaagaatcctttggtttccgacaccgaaataggaatgggtaacacggtccagtggaaaatgtgtacggtaactccaagtactaccatggccttgttcttcgaggtcgtcaaccaacattccgctcccatacctcaagggggaaggggctgcatacagttcatcacgcaatatcagcatgctagtggccagaagaggatccgagtaacgacagttgctagaaactgggccgatgcttccgctaatatacatcatgtcagtgctggattcgatcaggaggcagccgcagtgataatggcgaggatggcagtttacagagcggaatcagacgatagccctgatgttttgagatgggtcgataggatgttgatacgtctgtgccagaaattcggcgaatataacaaggacgacccgaattcgttccgcttgggcgaaaacttcagcctctacccgcagttcatgtaccatttgagaaggtcacagttcctgcaggtgtttaacaattctcccgacgaaacgtccttctacaggcacatgcttatgcgcgaagacctcacgcagtcgctgatcatgatccagccgatactctacagctacagtttcaatggaccaccagaacctgtgcttttggatacgagttccatccaacccgatagaattctgctcatggacacgttcttccagattctgatattccatggcgagacaatagcccaatggcgtaacctcaaatatcaggacatgcctgaatacgagaactttaggcagctgctgcaagctccagtggacgatgcccaggaaattcttcaaaccaggtttcctatgccgcgttacatcgatacggaacaaggaggatcacaggctagattcttgctctcgaaagtcaacccgagtcagactcacaacaatatgtacgcctacggaggggacggaggtgctccagttctcactgatgatgtatcgttacaagtattcatggatcacctgaaaaaactggcagtgtcctctacggcttagttgaccacgacggttcgaatactgcaaagacataacacaaacctaatggaggggattgatcagaaacatctcctgtataaacaaacggttgggatgttttaacagagagtcagtaaattatcatttgtggaacacaaaattttcaaaaaaacatttcaacactttccgcttttaactggcaaacccttcaaaagttattttgttccattaagttgtctccgattaagcagtatgtcgattctgttgaaatatctctgactgaaatggagatgttttactgtaaggtatcaaatcaaaactattttgtgtttttttttcaaatgtatttatttttaattcacaaatacatgatattactca

SEQ ID NO: 2494 - protein, 776 aa, Leptinotarsa decemlineata
MATYEEYIQQNEDRDGIRFTWNVWPSSRIEATRLVVPLACLYQPLKERPDLPPIQYDPVLCTRNNCRAILNPLCQVDYRAKLWVCNFCFQRNPFPPQYAAISEQHQPAELMPMFSTIEYTITRAQCLPPIYLYVVDTCMDEEELGSLKDSLQMSLSLLPPNALIGLITFGKMVQVHELGTEGCSKSYVFRGTKDLTAKQVQEMLEVGRAAVSAQPAPQQPGQPMRPGALQQAPTPPGSRFLQPISKCDMNLTDLIGELQRDPWPVHQGKCALRSTGTALSIAIGLLECTYANTGARVMLFVGGPCSQGPGQVLNDDLKQPIRSHHDIQKDNAKYMKKAIKHYDNLAMRAATNGHCVDIYSCALDQTGLMEMKQCCNSTGGHMVMGDSFNSSLFKQTFQRIFSKDQKNELKMAFNGTLEVKCSRELKIQGGIGSCVSLNVKNPLVSDTEIGMGNTVQWKMCTVTPSTTMALFFEVVNQHSAPIPQGGRGCIQFITQYQHASGQKRIRVTTVARNWADASANIHHVSAGFDQEAAAVIMARMAVYRAESDDSPDVLRWVDRMLIRLCQKFGEYNKDDPNSFRLGENFSLYPQFMYHLRRSQFLQVFNNSPDETSFYRHMLMREDLTQSLIMIQPILYSYSFNGPPEPVLLDTSSIQPDRILLMDTFFQILIFHGETIAQWRNLKYQDMPEYENFRQLLQAPVDDAQEILQTRFPMPRYIDTEQGGSQARFLLSKVNPSQTHNNMYAYGGDGGAPVLTDDVSLQVFMDHLKKLAVSSTA

SEQ ID NO: 2495 - DNA, 1504 bp, Leptinotarsa decemlineata
gcttgttgcccccgaatgccttgatagggttgattacctttgggaagatggtccaagtgcacgaactaggtaccgagggctgcagcaaatcttacgttttccgagggacgaaagacctcacagctaagcaagttcaagagatgttggaagtgggcagagccgcagtaagtgctcaacctgctcctcaacaaccaggacaacccatgaggcctggagcactccagcaagctcctacgccaccaggaagcaggttccttcaacccatctcgaaatgcgacatgaacctcactgatcttattggagagttgcaaagagacccatggcctgtccaccaaggcaaatgcgcccttagatcgaccgggacagctttatcgatagccattgggttgttggagtgcacatacgccaatactggtgccagggtcatgctattcgttggaggaccttgctctcaaggccctggtcaagtcttgaatgatgatctgaagcaacctatcagatctcaccacgacatccaaaaagacaatgccaaatacatgaagaaagcaatcaagcactatgataatttagcgatgagagcagcaacgaatggccactgcgttgacatatattcatgcgctttggatcagacaggattgatggagatgaaacagtgttgtaattcaacagggggacatatggtcatgggcgactcgttcaattcttccctgttcaagcaaacgttccagcgcatattttcgaaagatcagaaaaacgagctgaagatggcatttaatggtactctggaggtcaagtgttccagggagttgaaaattcaaggcggtattggatcttgtgtttcgttgaatgtgaagaatcctttggtttccgacaccgaaataggaatgggtaacacggtccagtggaaaatgtgtacggtaactccaagtactaccatggccttgttcttcgaggtcgtcaaccaacattccgctcccatacctcaagggggaaggggctgcatacagttcatcacgcaatatcagcatgctagtggccagaagaggatccgagtaacgacagttgctagaaactgggccgatgcttccgctaatatacatcatgtcagtgctggattcgatcaggaggcagccgcagtgataatggcgaggatggcagtttacagagcggaatcagacgatagccctgatgttttgagatgggtcgataggatgttgatacgtctgtgccagaaattcggcgaatataacaaggacgacccgaattcgttccgcttgggcgaaaacttcagcctctacccgcagttcatgtaccatttgagaaggtcacagttcctgcaggtgtttaacaattctcccgacgaaacgtccttctacaggcacatgcttatgcgcgaagacctcacgcagtcgctgatcatgatccagccgatactctacagctacagtttcaatggaccaccagaacctgtgcttttggatacgagttccatccaacccgatag